US006821519B2

(12) United States Patent
Day et al.

(10) Patent No.: US 6,821,519 B2
(45) Date of Patent: Nov. 23, 2004

(54) COMPOSITIONS AND METHODS FOR THE DIAGNOSIS AND TREATMENT OF HERPES SIMPLEX VIRUS INFECTION

(75) Inventors: Craig H. Day, Shoreline, WA (US); Nancy A. Hosken, Seattle, WA (US); Joseph M. Parsons, Seattle, WA (US)

(73) Assignee: Corixa Corporation, Seattle, WA (US)

( * ) Notice: Subject to any disclaimer, the term of this patent is extended or adjusted under 35 U.S.C. 154(b) by 0 days.

(21) Appl. No.: 10/237,551

(22) Filed: Sep. 6, 2002

(65) Prior Publication Data

US 2003/0165820 A1 Sep. 4, 2003

Related U.S. Application Data

(63) Continuation-in-part of application No. 10/200,562, filed on Jul. 19, 2002, now abandoned, which is a continuation-in-part of application No. 10/121,988, filed on Apr. 11, 2002, now abandoned, which is a continuation-in-part of application No. 09/894,998, filed on Jun. 28, 2001, now Pat. No. 6,537,555.
(60) Provisional application No. 60/277,438, filed on Mar. 20, 2001, and provisional application No. 60/215,458, filed on Jun. 29, 2000.

(51) Int. Cl.[7] .............................................. A61K 39/245
(52) U.S. Cl. ............................... 424/231.1; 424/204.1; 435/91.1; 530/300
(58) Field of Search ........................... 424/204.1, 231.1, 424/186.1; 435/91.1; 530/300

(56) References Cited

U.S. PATENT DOCUMENTS 6,210,929 B1    4/2001  Schlokat et al.

FOREIGN PATENT DOCUMENTS

| EP | 0531728 A1 | 3/1993 |
|---|---|---|
| WO | WO 98/20016 | * 5/1998 |
| WO | WO 98/55145 | 12/1998 |
| WO | WO 99/64633 | 12/1999 |
| WO | WO 00/08051 | 2/2000 |
| WO | WO 01/23414 | 4/2001 |

OTHER PUBLICATIONS

EMBL Accession No. P89466, XP–002201190, May 1, 1997.
EMBL Accession No. P09853, Oct. 1, 1996.
Verjans, Georges, M.G.M., et al., "Intraocular T Cells of Patients with Herpes Simplex Virus (HSV)—Induced Acute Retinal Necrosis Recognize HSV Tegument Proteins VP11/12 and VP13/14," *The Journal of Infectious Diseases*, vol. 182, pp. 923–927, XP–002201189, Sep. 2000.
International Search Report for International Application No. PCT/US01/20981; mailed Aug. 5, 2002; Applicant: Corixa Corporation; 7 pages.
D. J. McGeoch et al., "The Complete DNA Sequence of the Long Unique Region in the Genome of Herpes Simplex Virus Type 1," *Journal of General Virology*, vol. 69, pp. 1531–1574, 1988.

* cited by examiner

*Primary Examiner*—Ali R. Salimi
(74) *Attorney, Agent, or Firm*—Kristen K. Walker

(57) ABSTRACT

Compounds and methods for the diagnosis and treatment of HSV infection are provided. The compounds comprise polypeptides that contain at least one antigenic portion of an HSV polypeptide and DNA sequences encoding such polypeptides. Pharmaceutical compositions and vaccines comprising such polypeptides or DNA sequences are also provided, together with antibodies directed against such polypeptides. Diagnostic kits are also provided comprising such polypeptides and/or DNA sequences and a suitable detection reagent for the detection of HSV infection in patients and in biological samples.

8 Claims, No Drawings

COMPOSITIONS AND METHODS FOR THE DIAGNOSIS AND TREATMENT OF HERPES SIMPLEX VIRUS INFECTION

This application is a continuation in part of application Ser. No. 10/200,562 filed Jul. 19, 2002 now abandoned, which is a continuation in part of application Ser. No. 10/121,988 filed Apr. 11, 2002 now abandoned, which is a continuation in part of application Ser. No. 09/894,998 filed Jun. 28, 2001 now U.S. Pat. No. 6,537,555, which claims benefit of provisional application No. 60/277,438 filed Mar. 20, 2001, and claims benefit of provisional application No. 60/215,458 filed Jun. 29, 2000.

BACKGROUND OF THE INVENTION

1. Field of the Invention

The present invention relates generally to the detection and treatment of HSV infection. In particular, the invention relates to polypeptides comprising HSV antigens, DNA encoding HSV antigens, and the use of such compositions for the diagnosis and treatment of HSV infection.

2. Description of the Related Art

The herpes viruses include the herpes simplex viruses (HSV), comprising two closely related variants designated types 1 (HSV-1) and 2 (HSV-2). HSV is a prevalent cause of genital infection in humans, with an estimated annual incidence of 600,000 new cases and with 10 to 20 million individuals experiencing symptomatic chronic recurrent disease. The asymptomatic subclinical infection rate may be even higher. For example, using a type-specific serological assay, 35% of an unselected population of women attending a health maintenance organization clinic in Atlanta had antibodies to HSV type 2 (HSV-2). Although continuous administration of antiviral drugs such as acyclovir ameliorates the severity of acute HSV disease and reduces the frequency and duration of recurrent episodes, such chemotherapeutic intervention does not abort the establishment of latency nor does it alter the status of the latent virus. As a consequence, the recurrent disease pattern is rapidly reestablished upon cessation of drug treatment.

The genome of at least one strain of herpes simplex virus (HSV) has been characterized. It is approximately 150 kb and encodes about 85 known genes, each of which encodes a protein in the range of 50–1000 amino acids in length. Unknown, however, are the immunogenic portions, particularly immunogenic epitopes, that are capable of eliciting an effective T cell immune response to viral infection.

Thus, it is a matter of great medical and scientific need to identify immunogenic portions, preferably epitopes, of HSV polypeptides that are capable of eliciting an effective immune response to HSV infection. Such information will lead to safer and more effective prophylactic pharmaceutical compositions, e.g., vaccine compositions, to substantially prevent HSV infections, and, where infection has already occurred, therapeutic compositions to combat the disease. The present invention fulfills these and other needs.

BRIEF SUMMARY OF THE INVENTION

The present invention provides compositions and methods for the diagnosis and therapy of HSV infection. In one aspect, the present invention provides polypeptides comprising an immunogenic portion of a HSV antigen, or a variant or biological functional equivalent of such an antigen. Certain preferred portions and other variants are immunogenic, such that the ability of the portion or variant to react with antigen-specific antisera is not substantially diminished. Within certain embodiments, the polypeptide comprises an amino acid sequence encoded by a polynucleotide sequence selected from the group consisting of (a) a sequence of any one of SEQ ID NO: 1, 4, 8–9, 13, 16, 19 24, 35–38, 48–49, 52–53, 65–73, 76–89, 98–117, 118–119, 141, 144–152, 179–180 182–183, 184–194 206–210, 213–214, 217–226, 240, 242, 244–247, and 251–252; (b) a complement of said sequence; and (c) sequences that hybridize to a sequence of (a) or (b) under moderately stringent conditions. In specific embodiments, the polypeptides of the present invention comprise at least a portion, preferably at least an immunogenic portion, of a HSV protein that comprises some or all of an amino acid sequence recited in any one of SEQ ID NO: 2, 3, 5, 6, 7, 10–12, 14–15, 17–18, 20–23, 25–33, 39–47, 50–51, 54–64, 74–75, 90–97, 120–121, 122–140, 142–143, 153–178, 181, 195–205 211–212, 215–216, 227–239, 241, 243, 248–250, and 253–254 including variants and biological functional equivalents thereof.

The present invention further provides polynucleotides that encode a polypeptide as described above, or a portion thereof (such as a portion encoding at least 15 contiguous amino acid residues of a HSV protein), expression vectors comprising such polynucleotides and host cells transformed or transfected with such expression vectors.

In a related aspect, polynucleotide sequences encoding the above polypeptides, recombinant expression vectors comprising one or more of these polynucleotide sequences and host cells transformed or transfected with such expression vectors are also provided.

In another aspect, the present invention provides fusion proteins comprising one or more HSV polypeptides, for example in combination with a physiologically acceptable carrier or immunostimulant for use as pharmaceutical compositions and vaccines thereof.

The present invention further provides pharmaceutical compositions that comprise: (a) an antibody, either polyclonal and monoclonal, or antigen-binding fragment thereof that specifically binds to a HSV protein; and (b) a physiologically acceptable carrier.

Within other aspects, the present invention provides pharmaceutical compositions that comprise one or more HSV polypeptides or portions thereof disclosed herein, or a polynucleotide molecule encoding such a polypeptide, and a physiologically acceptable carrier. The invention also provides vaccines for prophylactic and therapeutic purposes comprising one or more of the disclosed polypeptides and an immunostimulant, as defined herein, as well as vaccines comprising one or more polynucleotide sequences encoding such polypeptides and an immunostimulant.

In yet another aspect, methods are provided for inducing protective immunity in a patient, comprising administering to a patient an effective amount of one or more of the above pharmaceutical compositions or vaccines. Any of the polypeptides identified for use in the treatment of patients can be used in conjunction with pharmaceutical agents used to treat herpes infections, such as, but not limited to, Zovirax® (Acyclovir), Valtrex® (Valacyclovir), and Famvir® (Famcyclovir).

In yet a further aspect, there are provided methods for treating, substantially preventing or otherwise ameliorating the effects of an HSV infection in a patient, the methods comprising obtaining peripheral blood mononuclear cells (PBMC) from the patient, incubating the PBMC with a polypeptide of the present invention (or a polynucleotide that encodes such a polypeptide) to provide incubated T cells and administering the incubated T cells to the patient. The present invention additionally provides methods for the treatment of HSV infection that comprise incubating antigen presenting cells with a polypeptide of the present invention (or a polynucleotide that encodes such a polypeptide) to provide incubated antigen presenting cells and administering the incubated antigen presenting cells to the patient. Proliferated cells may, but need not, be cloned prior to administration to the patient. In certain embodiments, the antigen presenting cells are selected from the group consisting of dendritic cells, macrophages, monocytes, B-cells, and fibroblasts. Compositions for the treatment of HSV infection comprising T cells or antigen presenting cells that have been incubated with a polypeptide or polynucleotide of the present invention are also provided. Within related aspects, vaccines are provided that comprise: (a) an antigen presenting cell that expresses a polypeptide as described above and (b) an immunostimulant.

The present invention further provides, within other aspects, methods for removing HSV-infected cells from a biological sample, comprising contacting a biological sample with T cells that specifically react with a HSV protein, wherein the step of contacting is performed under conditions and for a time sufficient to permit the removal of cells expressing the protein from the sample.

Within related aspects, methods are provided for inhibiting the development of HSV infection in a patient, comprising administering to a patient a biological sample treated as described above. In further aspects of the subject invention, methods and diagnostic kits are provided for detecting HSV infection in a patient. In one embodiment, the method comprises: (a) contacting a biological sample with at least one of the polypeptides or fusion proteins disclosed herein; and (b) detecting in the sample the presence of binding agents that bind to the polypeptide or fusion protein, thereby detecting HSV infection in the biological sample. Suitable biological samples include whole blood, sputum, serum, plasma, saliva, cerebrospinal fluid and urine. In one embodiment, the diagnostic kits comprise one or more of the polypeptides or fusion proteins disclosed herein in combination with a detection reagent. In yet another embodiment, the diagnostic kits comprise either a monoclonal antibody or a polyclonal antibody that binds with a polypeptide of the present invention.

The present invention also provides methods for detecting HSV infection comprising: (a) obtaining a biological sample from a patient; (b) contacting the sample with at least two oligonucleotide primers in a polymerase chain reaction, at least one of the oligonucleotide primers being specific for a polynucleotide sequence disclosed herein; and (c) detecting in the sample a polynucleotide sequence that amplifies in the presence of the oligonucleotide primers. In one embodiment, the oligonucleotide primer comprises at about 10 contiguous nucleotides of a polynucleotide sequence peptide disclosed herein, or of a sequence that hybridizes thereto.

In a further aspect, the present invention provides a method for detecting HSV infection in a patient comprising: (a) obtaining a biological sample from the patient; (b) contacting the sample with an oligonucleotide probe specific for a polynucleotide sequence disclosed herein; and (c) detecting in the sample a polynucleotide sequence that hybridizes to the oligonucleotide probe. In one embodiment, the oligonucleotide probe comprises at least about 15 contiguous nucleotides of a polynucleotide sequence disclosed herein, or a sequence that hybridizes thereto.

These and other aspects of the present invention will become apparent upon reference to the following detailed description. All references disclosed herein are hereby incorporated by reference in their entirety as if each was incorporated individually.

BRIEF DESCRIPTION OF THE SEVERAL SEQUENCE IDENTIFIERS

SEQ ID NO: 1 sets forth a polynucleotide sequence of an isolated clone designated HSV2I_UL39fragH12A12;

SEQ ID NO: 2 sets forth an amino acid sequence, designated H12A12orf1.pro, of an open reading frame encoded within the polynucleotide of SEQ ID NO: 1;

SEQ ID NO: 3 sets forth the amino acid sequence of the full length HSV-2 UL39 protein;

SEQ ID NO: 4 sets forth a polynucleotide sequence of an isolated clone designated HSV2II_US8AfragD6.B_B11_T7Trc.seq;

SEQ ID NO: 5 sets forth an amino acid sequence, designated D6Borf1.pro, of an open reading frame encoded within the polynucleotide of SEQ ID NO: 4;

SEQ ID NO: 6 sets forth an amino acid sequence, designated D6Borf2.pro, of an open reading frame encoded within the polynucleotide of SEQ ID NO: 4;

SEQ ID NO: 7 sets forth the amino acid sequence of the full length HSV-2 US8A protein;

SEQ ID NO: 8 sets forth a polynucleotide sequence of an isolated clone designated HSV2II_US4fragF10B3_T7Trc.seq;

SEQ ID NO: 9 sets forth a polynucleotide sequence of an isolated clone designated HSV2II_US3fragF10B3_T7P.seq;

SEQ ID NO: 10 sets forth an amino acid sequence, designated F10B3orf2.pro, of an open reading frame encoded within the polynucleotide of SEQ ID NO: 8;

SEQ ID NO: 11 sets forth an amino acid sequence, designated 8F10B3orf1.pro, of an open reading frame encoded within the polynucleotide of SEQ ID NO: 9;

SEQ ID NO: 12 sets forth the amino acid sequence of the full length HSV-2 US3 protein;

SEQ ID NO: 13 sets forth a polynucleotide sequence of an isolated clone designated HSV2II_UL46fragF11F5_T7Trc.seq SEQ ID NO: 14 sets forth an amino acid sequence, designated F11F5orf1.pro, of an open reading frame encoded within the polynucleotide of SEQ ID NO: 13;

SEQ ID NO: 15 sets forth the amino acid sequence of the full length HSV-2 UL46 protein;

SEQ ID NO: 16 sets forth a polynucleotide sequence of an isolated clone designated HSV2II_UL27fragH2C7_T7Trc.seq SEQ ID NO: 17 sets forth an amino acid sequence, designated H2C7orf1.pro, of an open reading frame encoded within the polynucleotide of SEQ ID NO: 16;

SEQ ID NO: 18 sets forth the amino acid sequence of the full length HSV-2 UL27 protein;

SEQ ID NO: 19 sets forth a polynucleotide sequence of an isolated clone designated HSV2II_UL18fragF10A1_rc.seq;

SEQ ID NO: 20 sets forth an amino acid sequence, designated F10A1 orf3.pro, of an open reading frame encoded within the polynucleotide of SEQ ID NO: 19;

SEQ ID NO: 21 sets forth an amino acid sequence, designated F10A1orf2.pro, of an open reading frame encoded within the polynucleotide of SEQ ID NO: 19;

SEQ ID NO: 22 sets forth an amino acid sequence, designated F10A1orf1.pro, of an open reading frame encoded within the polynucleotide of SEQ ID NO: 19;

SEQ ID NO: 23 sets forth the amino acid sequence of the full length HSV-2 UL18 protein;

SEQ ID NO: 24 sets forth a polynucleotide sequence of an isolated clone designated HSV2II__UL15fragF10A12__rc.seq;

SEQ ID NO: 25 sets forth an amino acid sequence, designated F10A12orf1.pro, of an open reading frame encoded within the polynucleotide of SEQ ID NO: 24;

SEQ ID NO: 26 sets forth the amino acid sequence of the full length HSV-2 UL15 protein;

SEQ ID NO:27 sets forth the amino acid sequence of a 15-mer polypeptide derived from an immunogenic portion of the HSVII UL46 gene;

SEQ ID NO:28 sets forth the amino acid sequence of a 15-mer polypeptide derived from an immunogenic portion of the HSVII UL46 gene;

SEQ ID NO:29 sets forth the amino acid sequence of a 15-mer polypeptide derived from an immunogenic portion of the HSVII UL46 gene;

SEQ ID NO:30 sets forth the amino acid sequence of a 15-mer polypeptide derived from an immunogenic portion of the HSVII UL46 gene;

SEQ ID NO:31 sets forth the amino acid sequence of a 15-mer polypeptide derived from an immunogenic portion of the HSVII UL46 gene;

SEQ ID NO:32 sets forth the amino acid sequence of a 15-mer polypeptide derived from an immunogenic portion of the HSVII UL18 gene;

SEQ ID NO:33 sets forth the amino acid sequence of a 15-mer polypeptide derived from an immunogenic portion of the HSVII UL18 gene;

SEQ ID NO:34 sets forth a nucleotide sequence of an isolated clone designated RL2__E9A4__5__consensus.seq;

SEQ ID NO:35 sets forth the nucleotide sequence of the full length HSV-2 RL2 gene;

SEQ ID NO:36 sets for the nucleotide sequence of an isolated clone designated UL23__22__C12A12__consensus.seq;

SEQ ID NO:37 sets forth the nucleotide sequence of the full length HSV-2 UL23 protein;

SEQ ID NO:38 sets forth the nucleotide sequence of the full length HSV-2 UL22 protein;

SEQ ID NO:39 sets forth an amino acid sequence, designated HSV2__UL23, of an open reading frame encoded by the polynucleotide of SEQ ID NO: 37;

SEQ ID NO:40 sets forth an amino acid sequence designated HSV2__UL23 of an open reading frame encoded within the polynucleotides of SEQ ID NO:36;

SEQ ID NO:41 sets forth an amino acid sequence designated HSV2__UL22 of an open reading frame encoded within the polynucleotides of SEQ ID NO:36;

SEQ ID NO:42 sets forth the amino acid sequence of a 15-mer polypeptide derived from an immunogenic portion of the HSVII UL23 gene;

SEQ ID NO:43 sets forth the amino acid sequence of a 15-mer polypeptide derived from an immunogenic portion of the HSVII UL23 gene;

SEQ ID NO:44 sets forth the amino acid sequence of a 15-mer polypeptide derived from an immunogenic portion of the HSVII UL23 gene;

SEQ ID NO:45 sets forth an amino acid sequence, designated HSV2__UL22, of an open reading frame encoded by the polynucleotide of SEQ ID NO:38;

SEQ ID NO:46 sets forth an amino acid sequence, designated RL2__E9A4__5__consensus.seq, of an open reading frame encoded by the polynucleotide of SEQ ID NO:34;

SEQ ID NO:47 sets forth an amino acid sequence, designated HSV2__RL2, of an open reading frame encoded by the polynucleotide of SEQ ID NO:35;

SEQ ID NO:48 sets forth a nucleotide sequence of an isolated clone designated G10__UL37consensus.seq;

SEQ ID NO:49 sets forth the nucleotide sequence of the full length HSV-2 UL37 gene;

SEQ ID NO:50 sets forth an amino acid sequence, designated HSV2__UL37, of an open reading frame encoded by the polynucleotide of SEQ ID NO:48; and SEQ ID NO:51 sets forth an amino acid sequence, designated HSV2__UL37, of an open reading frame encoded by the polynucleotide of SEQ ID NO:49;

SEQ ID NO:52 sets forth the DNA sequence derived from the insert of clone UL46fragF11F5;

SEQ ID NO:53 sets forth the DNA sequence derived from the insert of clone G10;

SEQ ID NO:54 sets forth the amino acid sequence derived from the insert of clone UL46fragF11F5;

SEQ ID NO:55 sets forth the amino acid sequence derived from the insert of clone G10;

SEQ ID NO:56 is amino acid sequence of peptide #23 (amino acids 688–702) of the HSV-2 gene UL15;

SEQ ID NO:57 is amino acid sequence of peptide #30 (amino acids 716–730) of the HSV-2 gene UL15;

SEQ ID NO:58 is amino acid sequence of peptide #7 (amino acids 265–279) of the HSV-2 gene UL23;

SEQ ID NO:59 is amino acid sequence of peptide #2 (amino acids 621–635) of the HSV-2 gene UL46;

SEQ ID NO:60 is amino acid sequence of peptide #8 (amino acids 645–659) of the HSV-2 gene UL46;

SEQ ID NO:61 is amino acid sequence of peptide #9 (amino acids 649–663) of the HSV-2 gene UL46;

SEQ ID NO:62 is amino acid sequence of peptide #11 (amino acids 657–671) of the HSV-2 gene UL46;

SEQ ID NO:63 is amino acid sequence of peptide #33 (amino acids 262–276) of the HSV-2 gene US3;

SEQ ID NO:64 is amino acid sequence of peptide #5 (amino acids 99–113) of the HSV-2 gene US8A.

SEQ ID NO:65 sets forth the polynucleotide sequence of the full length HSV-2 UL39 protein.

SEQ ID NO:66 sets forth the partial polynucleotide sequence of UL39 derived from the HSV2-III library, pools 1F4, 1G2, and 3G11 which were recognized by clone 39.

SEQ ID NO:67 sets forth the partial polynucleotide sequence of UL39 derived from the HSV2-III library, pool 2C4 which was recognized by clone 39.

SEQ ID NO:68 sets forth the 5' end of the partial polynucleotide sequence of ICP0 derived from the HSV2-III library, pools 3H6, 3F12, and 4B2 which were recognized by clone 47.

SEQ ID NO:69 sets forth the 3' end of the partial polynucleotide sequence of ICP0 derived from the HSV2-III library, pools 3H6, 3F12, and 4B2 which were recognized by clone 47.

SEQ ID NO:70 sets forth the 5' end of the partial polynucleotide sequence of ICP0 derived from the HSV2-III library, pool 3A1 which was recognized by clone 47.

SEQ ID NO:71 sets forth the 3' end of the partial polynucleotide sequence of ICP0 derived from the HSV2-III library, pool 3A1 which was recognized by clone 47.

SEQ ID NO:72 sets forth the 5' end of the partial polynucleotide sequence of ICP0 derived from the HSV2-III library, pool 2B2 which was recognized by clone 47.

SEQ ID NO:73 sets forth the 3' end of the partial polynucleotide sequence of ICP0 derived from the HSV2-III library, pool 2B2 which was recognized by clone 47.

SEQ ID NO:74 sets forth the partial amino acid sequence of UL39 derived from the HSV2-III library, pools 1F4, 1G2, and 3G11 which were recognized by clone 39.

SEQ ID NO:75 sets forth the partial amino acid sequence of UL39 derived from the HSV2-III library, pool 2C4 which was recognized by clone 39.

SEQ ID NO:76 sets forth a full length DNA sequence for the HSV-2 gene UL19.

SEQ ID NO:77 sets forth a DNA sequence for the vaccinia virus shuttle plasmid, pSC11.

SEQ ID NO:78 sets forth a full length DNA sequence for the HSV-2 gene, UL47.

SEQ ID NO:79 sets forth a full length DNA sequence for the HSV-2 gene, UL50.

SEQ ID NO:80 sets forth a DNA sequence for the human Ubiquitin gene.

SEQ ID NO:81 sets forth a full length DNA sequence for the HSV-2 gene, UL49.

SEQ ID NO:82 sets forth a DNA sequence corresponding to the coding region of the HSV gene, UL50.

SEQ ID NO:83 sets forth a DNA sequence corresponding to the coding region of the HSV gene, UL49.

SEQ ID NO:84 sets forth a DNA sequence corresponding to the coding region of the HSV gene, UL19.

SEQ ID NO:85 sets forth a DNA sequence corresponding to the coding region of the HSV gene, UL21.

SEQ ID NO:86 sets forth a DNA sequence corresponding to the coding region of the HSV-2 UL47 gene with the Trx2 fusion sequence.

SEQ ID NO:87 sets forth a DNA sequence corresponding to the coding region of the HSV gene, UL47.

SEQ ID NO:88 sets forth a DNA sequence corresponding to the coding region of the HSV gene, UL47 C fragment.

SEQ ID NO:89 sets forth a DNA sequence corresponding to the coding region of the HSV gene, UL39.

SEQ ID NO:90 sets forth an amino acid sequence corresponding to the UL39 protein with a His tag.

SEQ ID NO:91 sets forth an amino acid sequence corresponding to the UL21 protein with a His tag.

SEQ ID NO:92 sets forth an amino acid sequence corresponding to the UL47 protein fused with the Trx and 2 histadine tags.

SEQ ID NO:93 sets forth an amino acid sequence corresponding to the UL47 C fragment with a His tag.

SEQ ID NO:94 sets forth an amino acid sequence corresponding to the UL47 protein with a His tag.

SEQ ID NO:95 sets forth an amino acid sequence corresponding to the UL19 protein with a His tag.

SEQ ID NO:96 sets forth an amino acid sequence corresponding to the UL50 protein with a His tag.

SEQ ID NO:97 sets forth an amino acid sequence corresponding to the UL49 protein with a His tag.

SEQ ID NO:98 sets forth the primer sequence for the sense primer PDM-602, used in the amplification of UL21.

SEQ ID NO:99 sets forth the primer sequence for the reverse primer PDM-603, used in the amplification of UL21.

SEQ ID NO:100 sets forth the primer sequence for the sense primer PDM-466, used in the amplification of UL39.

SEQ ID NO:101 sets forth the primer sequence for the reverse primer PDM-467, used in the amplification of UL39.

SEQ ID NO:102 sets forth the primer sequence for the sense primer PDM-714, used in the amplification of UL49.

SEQ ID NO:103 sets forth the primer sequence for the reverse primer PDM-715, used in the amplification of UL49.

SEQ ID NO:104 sets forth the primer sequence for the sense primer PDM-458, used in the amplification of UL50.

SEQ ID NO:105 sets forth the primer sequence for the reverse primer PDM-459, used in the amplification of UL50.

SEQ ID NO:106 sets forth the primer sequence for the sense primer PDM-453, used in the amplification of UL19.

SEQ ID NO:107 sets forth the primer sequence for the reverse primer PDM-457, used in the amplification of UL19.

SEQ ID NO:108 sets forth the primer sequence for the sense primer PDM-631, used in the amplification of UL47.

SEQ ID NO:109 sets forth the primer sequence for the reverse primer PDM-632, used in the amplification of UL47.

SEQ ID NO:110 sets forth the primer sequence for the sense primer PDM-631, used in the amplification of UL47 A.

SEQ ID NO:111 sets forth the primer sequence for the reverse primer PDM-645, used in the amplification of UL47 A.

SEQ ID NO:112 sets forth the primer sequence for the sense primer PDM-646, used in the amplification of UL47 B.

SEQ ID NO:113 sets forth the primer sequence for the reverse primer PDM-632, used in the amplification of UL47 B.

SEQ ID NO:114 sets forth the primer sequence for the sense primer PDM-631, used in the amplification of UL47 C.

SEQ ID NO:115 sets forth the primer sequence for the reverse primer PDM-739, used in the amplification of UL47 C.

SEQ ID NO:116 sets forth the primer sequence for the sense primer PDM-740, used in the amplification of UL47 D.

SEQ ID NO:117 sets forth the primer sequence for the reverse primer PDM-632, used in the amplification of UL47 D.

SEQ ID NO:118 sets forth a novel DNA sequence for the HSV-2 gene, US8.

SEQ ID NO:119 sets forth the published DNA sequence for the HSV-2 gene, US8, derived from the HG52 strain of HSV-2.

SEQ ID NO:120 sets forth an amino acid sequence encoded by SEQ ID NO:118.

SEQ ID NO:121 sets forth an amino acid sequence encoded by SEQ ID NO:119.

SEQ ID NO:122 sets forth the sequence of peptide 85 (p85), a CD8+ peptide derived from the HSV-2 gene, UL47.

SEQ ID NO:123 sets forth the sequence of peptide 89 (p89), a CD8+ peptide derived from the HSV-2 gene, UL47.

SEQ ID NO:124 sets forth the sequence of peptide 98/99 (p98/99), a CD8+ peptide derived from the HSV-2 gene, UL47.

SEQ ID NO:125 sets forth the sequence of peptide 105 (p105), a CD8+ peptide derived from the HSV-2 gene, UL47.

SEQ ID NO:126 sets forth the sequence of peptide 112 (p112), a CD8+ peptide derived from the HSV-2 gene, UL47.

SEQ ID NO:127 sets forth the sequence of peptide #23 (amino acids 688–702) from the HSV-2 protein UL15.

SEQ ID NO:128 sets forth the sequence of peptide #30 (amino acids 716–730) from the HSV-2 protein UL15.

SEQ ID NO:129 sets forth the sequence of peptide #7 (amino acids 265–272) from the HSV-2 protein UL23.

SEQ ID NO:130 sets forth the sequence of peptide #2 (amino acids 621–635) from the HSV-2 protein UL46.

SEQ ID NO:131 sets forth the sequence of peptide #8 (amino acids 645–659) from the HSV-2 protein UL46.

SEQ ID NO:132 sets forth the sequence of peptide #9 (amino acids 649–663) from the HSV-2 protein UL46.

SEQ ID NO:133 sets forth the sequence of peptide #11 (amino acids 657–671) from the HSV-2 protein UL46.

SEQ ID NO:134 sets forth the sequence of peptide #86 (amino acids 341–355) from the HSV-2 protein UL47.

SEQ ID NO:135 sets forth the sequence of peptide #6 (amino acids 21–35) from the HSV-2 protein UL49.

SEQ ID NO:136 sets forth the sequence of peptide #12 (amino acids 45–59) from the HSV-2 protein UL49.

SEQ ID NO:137 sets forth the sequence of peptide #13 (amino acids 49–63) from the HSV-2 protein UL49.

SEQ ID NO:138 sets forth the sequence of peptide #49 (amino acids 193–208) from the HSV-2 protein UL49.

SEQ ID NO:139 sets forth the sequence of peptide #33 (amino acids 262–276) from the HSV-2 protein US3.

SEQ ID NO:140 sets forth the sequence of peptide #5 (amino acids 99–113) from the HSV-2 protein US8A.

SEQ ID NO:141 sets forth a full length insert DNA sequence corresponding to the clone F10B3.

SEQ ID NO:142 sets forth a full length insert amino acid sequence corresponding to the clone F10B3.

SEQ ID NO:143 sets forth an amino acid sequence for the HSV-2 protein, US4.

SEQ ID NO:144 sets forth a DNA sequence for the HSV-2 protein, UL21.

SEQ ID NO:145 sets forth a DNA sequence for the HSV-2 protein, UL50.

SEQ ID NO:146 sets forth a DNA sequence for the HSV-2 protein, US3.

SEQ ID NO:147 sets forth a DNA sequence for the HSV-2 protein, UL54.

SEQ ID NO:148 sets forth a DNA sequence for the HSV-2 protein, US8.

SEQ ID NO:149 sets forth a DNA sequence for the HSV-2 protein, UL19.

SEQ ID NO:150 sets forth a DNA sequence for the HSV-2 protein, UL46.

SEQ ID NO:151 sets forth a DNA sequence for the HSV-2 protein, UL18.

SEQ ID NO:152 sets forth a DNA sequence for the HSV-2 protein, RL2.

SEQ ID NO:153 sets forth an amino sequence for the HSV-2 protein, UL50.

SEQ ID NO:154 sets forth an amino acid sequence for the HSV-2 protein, UL21.

SEQ ID NO:155 sets forth an amino acid sequence for the HSV-2 protein, US3.

SEQ ID NO:156 sets forth an amino acid sequence for the HSV-2 protein, UL54.

SEQ ID NO:157 sets forth an amino acid sequence for the HSV-2 protein, US8.

SEQ ID NO:158 sets forth an amino acid sequence for the HSV-2 protein, UL19.

SEQ ID NO:159 sets forth an amino acid sequence for the HSV-2 protein, UL46.

SEQ ID NO:160 sets forth an amino acid sequence for the HSV-2 protein, UL18.

SEQ ID NO:161 sets forth an amino acid sequence for the HSV-2 protein, RL2.

SEQ ID NO:162 sets forth the sequence of peptide #43 (amino acids 211–225) from the HSV-2 protein RL2.

SEQ ID NO:163 sets forth the sequence of peptide #41 (amino acids 201–215) from the HSV-2 protein UL46.

SEQ ID NO:164 sets forth the sequence of peptide #50 (amino acids 246–260) from the HSV-2 protein UL46.

SEQ ID NO:165 sets forth the sequence of peptide #51 (amino acids 251–265) from the HSV-2 protein UL46.

SEQ ID NO:166 sets forth the sequence of peptide #60 (amino acids 296–310) from the HSV-2 protein UL46.

SEQ ID NO:167 sets forth the sequence of peptide #74 (amino acids 366–380) from the HSV-2 protein US8.

SEQ ID NO:168 sets forth the sequence of peptide #102 (amino acids 506–520) from the HSV-2 protein UL19.

SEQ ID NO:169 sets forth the sequence of peptide #103 (amino acids 511–525) from the HSV-2 protein UL19.

SEQ ID NO:170 sets forth the sequence of peptide #74 (amino acids 366–380) from the HSV-2 protein UL19.

SEQ ID NO:171 sets forth the sequence of peptide #75 (amino acids 371–385) from the HSV-2 protein UL19.

SEQ ID NO:172 sets forth the sequence of peptide #17 (amino acids 65–79) from the HSV-2 protein UL18.

SEQ ID NO:173 sets forth the sequence of peptide #18 (amino acids 69–83) from the HSV-2 protein UL18.

SEQ ID NO:174 sets forth the sequence of peptide #16 (amino acids 76–90) from the HSV-2 protein UL50.

SEQ ID NO:175 sets forth the sequence of peptide #23 (amino acids 111–125) from the HSV-2 protein UL50.

SEQ ID NO:176 sets forth the sequence of peptide #49 (amino acids 241–255) from the HSV-2 protein UL50.

SEQ ID NO:177 sets forth the sequence of a 9-mer peptide for ICP0(amino acids 215–223).

SEQ ID NO:178 sets forth the sequence of a 10-mer peptide for UL46 (amino acids 251–260).

SEQ ID NO:179 sets forth a DNA sequence of US4 derived from the HG52 strain of HSV-2.

SEQ ID NO:180 sets forth a DNA sequence for the UL47 F coding region.

SEQ ID NO:181 sets forth an amino acid sequence for the UL47 F coding region.

SEQ ID NO:182 sets forth the sequence for primer CBH-002 used in the amplification of UL47 F.

SEQ ID NO:183 sets forth the sequence for primer PDM-632 used in the amplification of UL47 F.

SEQ ID NO:184 sets forth a full length DNA sequence corresponding to the HSV-2 open reading frame, UL18.

SEQ ID NO:185 sets forth a full length DNA sequence corresponding to the HSV-2 open reading frame, LAT-ORF-1.

SEQ ID NO:186 sets forth a full length DNA sequence corresponding to the HSV-2 open reading frame, UL48.

SEQ ID NO:187 sets forth a full length DNA sequence corresponding to the HSV-2 open reading frame, UL41.

SEQ ID NO:188 sets forth a full length DNA sequence corresponding to the HSV-2 open reading frame, UL39.

SEQ ID NO:189 sets forth a full length DNA sequence corresponding to the HSV-2 open reading frame, UL37.

SEQ ID NO:190 sets forth a full length DNA sequence corresponding to the HSV-2 open reading frame, UL36.

SEQ ID NO:191 sets forth a full length DNA sequence corresponding to the HSV-2 open reading frame, UL29.

SEQ ID NO:192 sets forth a full length DNA sequence corresponding to the HSV-2 open reading frame, UL25.

SEQ ID NO:193 sets forth a full length DNA sequence corresponding to the HSV-2 open reading frame, ICP4.

SEQ ID NO:194 sets forth a full length DNA sequence corresponding to the HSV-2 open reading frame, ICP22.

SEQ ID NO:195 sets forth a full length amino acid sequence corresponding to the HSV-2 open reading frame, UL18.

SEQ ID NO:196 sets forth a full length amino acid sequence corresponding to the HSV-2 open reading frame, ICP22.

SEQ ID NO:197 sets forth a full length DNA sequence corresponding to the HSV-2 open reading frame, ICP4.

SEQ ID NO:198 sets forth a full length DNA sequence corresponding to the HSV-2 open reading frame, LAT-ORF-1.

SEQ ID NO:199 sets forth a full length DNA sequence corresponding to the HSV-2 open reading frame, UL25.

SEQ ID NO:200 sets forth a full length DNA sequence corresponding to the HSV-2 open reading frame, UL29.

SEQ ID NO:201 sets forth a full length DNA sequence corresponding to the HSV-2 open reading frame, UL36.

SEQ ID NO:202 sets forth a full length DNA sequence corresponding to the HSV-2 open reading frame, UL37.

SEQ ID NO:203 sets forth a full length DNA sequence corresponding to the HSV-2 open reading frame, UL39.

SEQ ID NO:204 sets forth a full length DNA sequence corresponding to the HSV-2 open reading frame, UL41.

SEQ ID NO:205 sets forth a full length DNA sequence corresponding to the HSV-2 open reading frame, UL48.

SEQ ID NO:206 sets forth the DNA sequence from the *E. coli* expression cloning library inserts 1/F3 and 1/A7.

SEQ ID NO:207 sets forth the DNA sequence from the *E. coli* expression cloning library insert 1/H6.

SEQ ID NO:208 sets forth the DNA sequence from the *E. coli* expression cloning library insert 3/C1.

SEQ ID NO:209 sets forth the DNA sequence common to the inserts 1/F3, 1/A7, 1/H6, and 3/C1.

SEQ ID NO:210 sets forth a full length DNA sequence for the UL19 gene derived from HSV-2 strain HG52.

SEQ ID NO:211 sets forth the amino acid sequence encoded by SEQ ID NO:209.

SEQ ID NO:212 sets forth a full length amino acid sequence for the UL19 gene derived from the HSV-2 strain HG52.

SEQ ID NO:213 sets forth the full length DNA sequence for the US8 gene derived from the clinical isolate RW1874.

SEQ ID NO:214 sets forth the full length DNA sequence for the US8 gene derived from the clinical isolate HV5101.

SEQ ID NO:215 sets forth the full length amino acid sequence for the US8 gene derived from the clinical isolate RW1874.

SEQ ID NO:216 sets forth the full length amino acid sequence for the US8 gene derived from the clinical isolate HV5101.

SEQ ID NO:217 sets forth the DNA sequence corresponding to the insert from clone HH6 D6_B6.

SEQ ID NO:218 sets forth a DNA sequence for the UL21 gene derived from the HSV-2 strain HG52.

SEQ ID NO:219 sets forth a DNA sequence corresponding to the first insert of clone HH20 C12_E1.

SEQ ID NO:220 sets forth a DNA sequence corresponding to the second insert of clone HH20 C12_E1.

SEQ ID NO:221 sets forth a DNA sequence for the UL29 gene derived from the HSV-2 strain HG52.

SEQ ID NO:222 sets forth the DNA sequence corresponding to the insert from clone HH22 F7_A7.

SEQ ID NO:223 sets forth the DNA sequence corresponding to the insert from clone HH22 4/E8_C8.

SEQ ID NO:224 sets forth a DNA sequence for the UL46 gene derived from the HSV-2 strain HG52.

SEQ ID NO:225 sets forth a DNA sequence corresponding to the insert from the clone HH24 G6_H11.

SEQ ID NO:226 sets forth a DNA sequence for the UL47 gene derived from the HSV-2 strain HG52.

SEQ ID NO:227 sets forth a protein sequence encoded by the insert from clone HH6 (D6B6:SEQ ID NO:217).

SEQ ID NO:228 sets forth a full length amino acid sequence for UL21 derived from the HG52 strain of HSV-2.

SEQ ID NO:229 sets forth an amino acid sequence of the UL21 T cell epitope spanning amino acids 281 to 300.

SEQ ID NO:230 sets forth an amino acid sequence encoded by the insert 1C12_E1, from clone HH20.

SEQ ID NO:231 sets forth an amino acid sequence encoded by the insert 2E9_D11, from clone HH20 .

SEQ ID NO:232 sets forth a full-length amino acid sequence for the HSV-2, strain HG52 protein, UL29.

SEQ ID NO:233 sets forth an amino acid sequence from insert F7_A1, clone HH22.

SEQ ID NO:234 sets forth an amino acid sequence from insert 4/E8_C8, clone HH22.

SEQ ID NO:235 sets forth a full-length amino acid sequence for the UL46 protein derived from the HG52 strain of HSV-2.

SEQ ID NO:236 sets forth an amino acid sequence of the reactive T cell epitope derived from UL46, spanning amino acids 621 to 649.

SEQ ID NO:237 sets forth an amino acid sequence encoded by the insert derived from clone HH24 G6_H11.

SEQ ID NO:238 sets forth a full-length amino acid sequence for the HSV-2 gene UL47.

SEQ ID NO:239 sets forth an amino acid sequence of the reactive T cell epitope derived from UL47 spanning amino acids 137–155.

SEQ ID NO:240 sets forth a DNA sequence corresponding to the clone insert TM13 and TM58 F5_G1.

SEQ ID NO:241 sets forth an amino acid sequence encoded by the clone insert TM13 and TM58 F5_G1.

SEQ ID NO:242 sets forth a full length DNA sequence corresponding to the HSV-2 gene, UL54.

SEQ ID NO:243 sets forth a full length amino acid sequence corresponding to UL54 (ICP27) derived from the HG52 strain of HSV-2.

SEQ ID NO:244 sets forth a DNA sequence corresponding to the insert TM39, H11_C3.

SEQ ID NO:245 sets forth a full length DNA sequence corresponding to UL21, derived from the HSV-2 strain, HG52.

SEQ ID NO:246 sets forth a full length DNA sequence corresponding to UL22, derived from the HSV-2 strain, HG52.

SEQ ID NO:247 sets forth a full length DNA sequence corresponding to UL36, derived from the HSV-2 strain, HG52.

SEQ ID NO:248 sets forth a full length amino acid sequence corresponding to UL21 derived from the HG52 strain of HSV-2.

SEQ ID NO:249 sets forth a full length amino acid sequence corresponding to UL22 derived from the HG52 strain of HSV-2.

SEQ ID NO:250 sets forth a full length amino acid sequence corresponding to UL36 derived from the HG52 strain of HSV-2.

SEQ ID NO:251 sets forth a DNA sequence corresponding to the insert of TM51, F7_A8.

SEQ ID NO:252 sets forth a full length DNA sequence corresponding to US4, derived from the HSV-2 strain, HG52.

SEQ ID NO:253 sets forth an amino acid sequence corresponding to clone TM51F7_A8.

SEQ ID NO:254 sets forth a full length amino acid sequence corresponding to US4 derived from the HG52 strain of HSV-2.

DETAILED DESCRIPTION OF THE INVENTION

U.S. patents, U.S. patent application publications, U.S. patent applications, foreign patents, foreign patent applications and non-patent publications referred to in this specification and/or listed in the Application Data Sheet, are incorporated herein by reference, in their entirety.

As noted above, the present invention is generally directed to compositions and methods for making and using the compositions, particularly in the therapy and diagnosis of HSV infection. Certain illustrative compositions described herein include HSV polypeptides, polynucleotides encoding such polypeptides, binding agents such as antibodies, antigen presenting cells (APCs) and/or immune system cells (e.g., T cells). Certain HSV proteins and immunogenic portions thereof comprise HSV polypeptides that react detectably (within an immunoassay, such as an ELISA or Western blot) with antisera of a patient infected with HSV.

Therefore, the present invention provides illustrative polynucleotide compositions, illustrative polypeptide compositions, immunogenic portions of said polynucleotide and polypeptide compositions, antibody compositions capable of binding such polypeptides, and numerous additional embodiments employing such compositions, for example in the detection, diagnosis and/or therapy of human HSV infections.

Polynucleotide Compositions

As used herein, the terms "DNA segment" and "polynucleotide" refer to a DNA molecule that has been isolated free of total genomic DNA of a particular species. Therefore, a DNA segment encoding a polypeptide refers to a DNA segment that contains one or more coding sequences yet is substantially isolated away from, or purified free from, total genomic DNA of the species from which the DNA segment is obtained. Included within the terms "DNA segment" and "polynucleotide" are DNA segments and smaller fragments of such segments, and also recombinant vectors, including, for example, plasmids, cosmids, phagemids, phage, viruses, and the like.

As will be understood by those skilled in the art, the DNA segments of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

"Isolated," as used herein, means that a polynucleotide is substantially away from other coding sequences, and that the DNA segment does not contain large portions of unrelated coding DNA, such as large chromosomal fragments or other functional genes or polypeptide coding regions. Of course, this refers to the DNA segment as originally isolated, and does not exclude genes or coding regions later added to the segment by the hand of man.

As will be recognized by the skilled artisan, polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes an HSV protein or a portion thereof) or may comprise a variant, or a biological or antigenic functional equivalent of such a sequence. Polynucleotide variants may contain one or more substitutions, additions, deletions and/or insertions, as further described below, preferably such that the immunogenicity of the encoded polypeptide is not diminished, relative to a native HSV protein. The effect on the immunogenicity of the encoded polypeptide may generally be assessed as described herein. The term "variants" also encompasses homologous genes of xenogenic origin.

When comparing polynucleotide or polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O., *A model of evolutionary change in proteins—Matrices for detecting distant relationships,* 1978. In Dayhoff, M. O. (ed.), Atlas of Protein Sequence and Structure, National Biomedical Research Foundation, Washington D.C., Vol. 5, Suppl. 3, pp. 345–358; Hein J., *Unified Approach to Alignment and Phylogenes,* "Methods in Enzymology," Academic Press, Inc., San Diego, Calif. vol. 183, pp. 626–645, 1990; Higgins, D. G. and P. M. Sharp, *CABIOS* 5:151–53, 1989; Myers, E. W. and W. Muller, *CABIOS* 4:11–17, 1988; Robinson, E. D., *Comb. Theor* 11:105, 1971; Santou, N. and M. Nes, *Mol. Biol. Evol.*

4:406–25,1987; Sneath, P. H. A. and R. R. Sokal, *Numerical Taxonomy—the Principles and Practice of Numerical Taxonomy*, Freeman Press, San Francisco, Calif., 1973; Wilbur, W. J. and D. J. Lipman, *Proc. Natl. Acad., Sci. USA* 80:726–30, 1983.

Alternatively, optimal alignment of sequences for comparison may be conducted by the local identity algorithm of Smith and Waterman, *Add. APL. Math* 2:482, 1981, by the identity alignment algorithm of Needleman and Wunsch, *J. Mol. Biol.* 48:443, 1970, by the search for similarity methods of Pearson and Lipman, *Proc. Natl. Acad. Sci. USA* 85:2444, 1988, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al., *Nucl. Acids Res.* 25:3389–3402, 1977; and Altschul et al., *J. Mol. Biol.* 215:403–10, 1990, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff, *Proc. Natl. Acad. Sci. USA* 89:10915, 1989) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e., the window size) and multiplying the results by 100 to yield the percentage of sequence identity.

Therefore, the present invention encompasses polynucleotide and polypeptide sequences having substantial identity to the sequences disclosed herein, for example those comprising at least 50% sequence identity, preferably at least 55%, 60%, 65%, 70%, 75%, 80%, 85%, 90%, 95%, 96%, 97%, 98%, or 99% or higher, sequence identity compared to a polynucleotide or polypeptide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

In additional embodiments, the present invention provides isolated polynucleotides and polypeptides comprising various lengths of contiguous stretches of sequence identical to or complementary to one or more of the sequences disclosed herein. For example, polynucleotides are provided by this invention that comprise at least about 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200–500; 500–1,000, and the like.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative DNA segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

In other embodiments, the present invention is directed to polynucleotides that are capable of hybridizing under moderately stringent conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.–65° C., 5×SSC, overnight; followed by washing twice at 65° C. for 20 minutes with each of 2×, 0.5× and 0.2× SSC containing 0.1% SDS.

Moreover, it will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Probes and Primers

In other embodiments of the present invention, the polynucleotide sequences provided herein can be advantageously used as probes or primers for nucleic acid hybridization. As such, it is contemplated that nucleic acid segments that comprise a sequence region of at least about 15 nucleotide long contiguous sequence that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10–14, 15–20, 30, 50, or even of 100–200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch (es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15–25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review the sequence set forth in the sequences disclosed herein, or to any continuous portion of the sequence, from about 15–25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

Polynucleotide Identification and Characterization

Polynucleotides may be identified, prepared and/or manipulated using any of a variety of well established techniques. For example, a polynucleotide may be identified, as described in more detail below, by screening a microarray of cDNAs for HSV-associated expression (i.e., expression that is at least two fold greater in infected versus normal tissue, as determined using a representative assay provided herein). Such screens may be performed, for example, using a Synteni microarray (Palo Alto, Calif.) according to the manufacturer's instructions (and essentially as described by Schena et al., *Proc. Natl. Acad. Sci. USA* 93:10614–10619, 1996 and Heller et al., *Proc. Natl. Acad. Sci. USA* 94:2150–2155, 1997). Alternatively, polynucleotides may be amplified from cDNA prepared from cells expressing the proteins described herein. Such polynucleotides may be amplified via polymerase chain reaction (PCR). For this approach, sequence-specific primers may be designed based on the sequences provided herein, and may be purchased or synthesized.

An amplified portion of a polynucleotide of the present invention may be used to isolate a full length gene from a suitable library (e.g., an HSV cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$)

using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, there are numerous amplification techniques for obtaining a full length coding sequence from a partial cDNA sequence. Within such techniques, amplification is generally performed via PCR. Any of a variety of commercially available kits may be used to perform the amplification step. Primers may be designed using, for example, software well known in the art. Primers are preferably 22–30 nucleotides in length, have a GC content of at least 50% and anneal to the target sequence at temperatures of about 68° C. to 72° C. The amplified region may be sequenced as described above, and overlapping sequences assembled into a contiguous sequence.

One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111–19, 1991) and walking PCR (Parker et al., *Nucl. Acids. Res.* 19:3055–60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

Polynucleotide Expression in Host Cells

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) *Nucl. Acids Res. Symp. Ser.* 215–223, Horn, T. et al. (1980) *Nucl. Acids Res. Symp. Ser.* 225–232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) *Science* 269:202–204) and automated synthesis may be achieved, for example, using the ABI 431A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) *J. Biol. Chem.* 264:5503–5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, *Saccharomyces cerevisiae*, a number of vectors containing constitutive or inducible promoters such as alpha factor, alcohol oxidase, and PGH may be used. For reviews, see Ausubel et al. (supra) and Grant et al. (1987) *Methods Enzymol.* 153:516–544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) *EMBO J.* 6:307–311. Alternatively, plant promoters such as the small subunit of RUBISCO or heat shock promoters may be used (Coruzzi, G. et al. (1984) *EMBO J.* 3:1671–1680; Broglie, R. et al. (1984) *Science* 224:838–843; and Winter, J. et al. (1991) *Results Probl. Cell Differ.* 17:85–105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191–196).

An insect system may also be used to express a polypeptide of interest. For example, in one such system, *Autographa californica* nuclear polyhedrosis virus (AcNPV) is used as a vector to express foreign genes in *Spodoptera frugiperda* cells or in *Trichoplusia* larvae. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, *S. frugiperda* cells or *Trichoplusia* larvae in which the polypeptide of interest may be expressed (Engelhard, E. K. et al. (1994) *Proc. Natl. Acad. Sci.* 91:3224–3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) *Proc. Natl. Acad. Sci.* 81:3655–3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) *Results Probl. Cell Differ.* 20:125–162).

In addition, a host cell strain may be chosen for its ability to modulate the expression of the inserted sequences or to process the expressed protein in the desired fashion. Such modifications of the polypeptide include, but are not limited to, acetylation, carboxylation, glycosylation, phosphorylation, lipidation, and acylation. Post-translational processing which cleaves a "prepro" form of the protein may also be used to facilitate correct insertion, folding and/or function. Different host cells such as CHO, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) *Cell* 11:223–32) and adenine phosphoribosyltransferase (Lowy, I. et al. (1990) *Cell* 22:817–23) genes which can be employed in tk.sup.- or aprt.sup.-cells, respectively. Also, antimetabolite, antibiotic or herbicide resistance can be used as the basis for selection; for example, dhfr which confers resistance to methotrexate (Wigler, M. et al. (1980) *Proc. Natl. Acad. Sci.* 77:3567–70); npt, which confers resistance to the aminoglycosides, neomycin and G-418 (Colbere-Garapin, F. et al (1981) *J. Mol. Biol.* 150:1–14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) *Proc. Natl. Acad. Sci.* 85:8047–51). Recently, the use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121–131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells which contain and express a desired polynucleotide sequence may be identified by a variety of procedures known to those of skill in the art. These procedures include, but are not limited to, DNA—DNA or DNA-RNA hybridizations and protein bioassay or immunoassay techniques which include membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; *J. Exp. Med.* 158:1211–1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen, San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, *Prot. Exp. Purif.* 3:263–281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441–453).

In addition to recombinant production methods, polypeptides of the invention, and fragments thereof, may be produced by direct peptide synthesis using solid-phase techniques (Merrifield J. (1963) *J. Am. Chem. Soc.* 85:2149–2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

Site-Specific Mutagenesis

Site-specific mutagenesis is a technique useful in the preparation of individual peptides, or biologically functional equivalent polypeptides, through specific mutagenesis of the underlying polynucleotides that encode them. The technique, well-known to those of skill in the art, further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the antigenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as *E. coli* cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

Polynucleotide Amplification Techniques

A number of template dependent processes are available to amplify the target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Another method for amplification is the ligase chain reaction (referred to as LCR), disclosed in Eur. Pat. Appl. Publ. No. 320,308 (specifically incorporated herein by reference in its entirety). In LCR, two complementary probe pairs are prepared, and in the presence of the target sequence, each pair will bind to opposite complementary strands of the target such that they abut. In the presence of a ligase, the two probe pairs will link to form a single unit. By temperature cycling, as in PCR™, bound ligated units dissociate from the target and then serve as "target sequences" for ligation of excess probe pairs. U.S. Pat. No. 4,883,750, incorporated herein by reference in its entirety, describes an alternative method of amplification similar to LCR for binding probe pairs to a target sequence.

Qbeta Replicase, described in PCT Intl. Pat. Appl. Publ. No. PCT/US87/00880, incorporated herein by reference in its entirety, may also be used as still another amplification method in the present invention. In this method, a replicative sequence of RNA that has a region complementary to that of a target is added to a sample in the presence of an RNA polymerase. The polymerase will copy the replicative sequence that can then be detected.

An isothermal amplification method, in which restriction endonucleases and ligases are used to achieve the amplification of target molecules that contain nucleotide 5'-[α-thio] triphosphates in one strand of a restriction site (Walker et al., 1992, incorporated herein by reference in its entirety), may also be useful in the amplification of nucleic acids in the present invention.

Strand Displacement Amplification (SDA) is another method of carrying out isothermal amplification of nucleic acids which involves multiple rounds of strand displacement and synthesis, i.e. nick translation. A similar method, called Repair Chain Reaction (RCR) is another method of amplification which may be useful in the present invention and is involves annealing several probes throughout a region targeted for amplification, followed by a repair reaction in which only two of the four bases are present. The other two bases can be added as biotinylated derivatives for easy detection. A similar approach is used in SDA.

Sequences can also be detected using a cyclic probe reaction (CPR). In CPR, a probe having a 3' and 5' sequences of non-target DNA and an internal or "middle" sequence of the target protein specific RNA is hybridized to DNA which is present in a sample. Upon hybridization, the reaction is treated with RNaseH, and the products of the probe are identified as distinctive products by generating a signal that is released after digestion. The original template is annealed to another cycling probe and the reaction is repeated. Thus, CPR involves amplifying a signal generated by hybridization of a probe to a target gene specific expressed nucleic acid.

Still other amplification methods described in Great Britain Pat. Appl. No. 2 202 328, and in PCT Intl. Pat. Appl. Publ. No. PCT/US89/01025, each of which is incorporated herein by reference in its entirety, may be used in accordance with the present invention. In the former application, "modified" primers are used in a PCR-like, template and enzyme dependent synthesis. The primers may be modified by labeling with a capture moiety (e.g., biotin) and/or a detector moiety (e.g., enzyme). In the latter application, an excess of labeled probes is added to a sample. In the presence of the target sequence, the probe binds and is cleaved catalytically. After cleavage, the target sequence is released intact to be bound by excess probe. Cleavage of the labeled probe signals the presence of the target sequence.

Other nucleic acid amplification procedures include transcription-based amplification systems (TAS) (Kwoh et al., 1989; PCT Intl. Pat. Appl. Publ. No. WO 88/10315, incorporated herein by reference in its entirety), including nucleic acid sequence based amplification (NASBA) and 3SR. In NASBA, the nucleic acids can be prepared for amplification by standard phenol/chloroform extraction, heat denaturation of a sample, treatment with lysis buffer and minispin columns for isolation of DNA and RNA or guanidinium chloride extraction of RNA. These amplification techniques involve annealing a primer that has sequences specific to the target sequence. Following polymerization, DNA/RNA hybrids are digested with RNase H while double stranded DNA molecules are heat-denatured again. In either case the single stranded DNA is made fully double stranded by addition of second target-specific primer, followed by polymerization. The double stranded DNA molecules are then multiply transcribed by a polymerase such as T7 or SP6. In an isothermal cyclic reaction, the RNAs are reverse transcribed into DNA, and transcribed once again with a polymerase such as T7 or SP6. The resulting products, whether truncated or complete, indicate target-specific sequences.

Eur. Pat. Appl. Publ. No. 329,822, incorporated herein by reference in its entirety, disclose a nucleic acid amplification process involving cyclically synthesizing single-stranded RNA ("ssRNA"), ssDNA, and double-stranded DNA (dsDNA), which may be used in accordance with the present invention. The ssRNA is a first template for a first primer oligonucleotide, which is elongated by reverse transcriptase (RNA-dependent DNA polymerase). The RNA is then removed from resulting DNA:RNA duplex by the action of ribonuclease H (RNase H, an RNase specific for RNA in a duplex with either DNA or RNA). The resultant ssDNA is a second template for a second primer, which also includes the sequences of an RNA polymerase promoter (exemplified by T7 RNA polymerase) 5' to its homology to its template. This primer is then extended by DNA polymerase (exemplified by the large "Klenow" fragment of E. coli DNA polymerase I), resulting as a double-stranded DNA ("dsDNA") molecule, having a sequence identical to that of the original RNA between the primers and having additionally, at one end, a promoter sequence. This promoter sequence can be used by the appropriate RNA polymerase to make many RNA copies of the DNA. These copies can then re-enter the cycle leading to very swift amplification. With proper choice of enzymes, this amplification can be done isothermally without addition of enzymes at each cycle. Because of the cyclical nature of this process, the starting sequence can be chosen to be in the form of either DNA or RNA.

PCT Intl. Pat. Appl. Publ. No. WO 89/06700, incorporated herein by reference in its entirety, disclose a nucleic acid sequence amplification scheme based on the hybridization of a promoter/primer sequence to a target single-stranded DNA ("ssDNA") followed by transcription of many RNA copies of the sequence. This scheme is not cyclic; i.e., new templates are not produced from the resultant RNA transcripts. Other amplification methods include "RACE" (Frohman, 1990), and "one-sided PCR" (Ohara, 1989) which are well-known to those of skill in the art.

Methods based on ligation of two (or more) oligonucleotides in the presence of nucleic acid having the sequence of the resulting "di-oligonucleotide", thereby amplifying the di-oligonucleotide (Wu and Dean, 1996, incorporated herein by reference in its entirety), may also be used in the amplification of DNA sequences of the present invention.

Biological Functional Equivalents

Modification and changes may be made in the structure of the polynucleotides and polypeptides of the present invention and still obtain a functional molecule that encodes a polypeptide with desirable characteristics. As mentioned above, it is often desirable to introduce one or more mutations into a specific polynucleotide sequence. In certain circumstances, the resulting encoded polypeptide sequence is altered by this mutation, or in other cases, the sequence of the polypeptide is unchanged by one or more mutations in the encoding polynucleotide.

When it is desirable to alter the amino acid sequence of a polypeptide to create an equivalent, or even an improved, second-generation molecule, the amino acid changes may be achieved by changing one or more of the codons of the encoding DNA sequence, according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated by the inventors that various changes may be made in the peptide sequences of the disclosed compositions, or corresponding DNA sequences which encode said peptides without appreciable loss of their biological utility or activity.

TABLE 1

| Amino Acids | | | Codons |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e., still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

In Vivo Polynucleotide Delivery Techniques

In additional embodiments, genetic constructs comprising one or more of the polynucleotides of the invention are introduced into cells in vivo. This may be achieved using any of a variety or well known approaches, several of which are outlined below for the purpose of illustration.

1. Adenovirus

One of the preferred methods for in vivo delivery of one or more nucleic acid sequences involves the use of an adenovirus expression vector. "Adenovirus expression vector" is meant to include those constructs containing adenovirus sequences sufficient to (a) support packaging of the construct and (b) to express a polynucleotide that has been cloned therein in a sense or antisense orientation. Of course, in the context of an antisense construct, expression does not require that the gene product be synthesized.

The expression vector comprises a genetically engineered form of an adenovirus. Knowledge of the genetic organization of adenovirus, a 36 kb, linear, double-stranded DNA virus, allows substitution of large pieces of adenoviral DNA with foreign sequences up to 7 kb (Grunhaus and Horwitz, 1992). In contrast to retrovirus, the adenoviral infection of host cells does not result in chromosomal integration because adenoviral DNA can replicate in an episomal manner without potential genotoxicity. Also, adenoviruses are structurally stable, and no genome rearrangement has been detected after extensive amplification. Adenovirus can infect virtually all epithelial cells regardless of their cell cycle stage. So far, adenoviral infection appears to be linked only to mild disease such as acute respiratory disease in humans.

Adenovirus is particularly suitable for use as a gene transfer vector because of its mid-sized genome, ease of manipulation, high titer, wide target-cell range and high infectivity. Both ends of the viral genome contain 100–200 base pair inverted repeats (ITRs), which are cis elements necessary for viral DNA replication and packaging. The early (E) and late (L) regions of the genome contain different transcription units that are divided by the onset of viral DNA replication. The E1 region (E1A and E1B) encodes proteins responsible for the regulation of transcription of the viral genome and a few cellular genes. The expression of the E2 region (E2A and E2B) results in the synthesis of the proteins for viral DNA replication. These proteins are involved in DNA replication, late gene expression and host cell shut-off (Renan, 1990). The products of the late genes, including the majority of the viral capsid proteins, are expressed only after significant processing of a single primary transcript issued by the major late promoter (MLP). The MLP, (located at 16.8 m.u.) is particularly efficient during the late phase of infection, and all the mRNA's issued from this promoter possess a 5'-tripartite leader (TPL) sequence which makes them preferred mRNA's for translation.

In a current system, recombinant adenovirus is generated from homologous recombination between shuttle vector and provirus vector. Due to the possible recombination between two proviral vectors, wild-type adenovirus may be generated from this process. Therefore, it is critical to isolate a single clone of virus from an individual plaque and examine its genomic structure.

Generation and propagation of the current adenovirus vectors, which are replication deficient, depend on a unique helper cell line, designated 293, which was transformed from human embryonic kidney cells by Ad5 DNA fragments and constitutively expresses E1 proteins (Graham et al., 1977). Since the E3 region is dispensable from the adenovirus genome (Jones and Shenk, 1978), the current adenovirus vectors, with the help of 293 cells, carry foreign DNA in either the E1, the D3 or both regions (Graham and Prevec, 1991). In nature, adenovirus can package approximately 105% of the wild-type genome (Ghosh-Choudhury et al., 1987), providing capacity for about 2 extra kB of DNA. Combined with the approximately 5.5 kB of DNA that is replaceable in the E1 and E3 regions, the maximum capacity of the current adenovirus vector is under 7.5 kB, or about 15% of the total length of the vector. More than 80% of the adenovirus viral genome remains in the vector backbone and is the source of vector-borne cytotoxicity. Also, the replication deficiency of the E1-deleted virus is incomplete. For example, leakage of viral gene expression has been observed with the currently available vectors at high multiplicities of infection (MOI) (Mulligan, 1993).

Helper cell lines may be derived from human cells such as human embryonic kidney cells, muscle cells, hematopoietic cells or other human embryonic mesenchymal or epithelial cells. Alternatively, the helper cells may be derived from the cells of other mammalian species that are permissive for human adenovirus. Such cells include, e.g., Vero cells or other monkey embryonic mesenchymal or epithelial cells. As stated above, the currently preferred helper cell line is 293.

Recently, Racher et al. (1995) disclosed improved methods for culturing 293 cells and propagating adenovirus. In one format, natural cell aggregates are grown by inoculating individual cells into 1 liter siliconized spinner flasks (Techne, Cambridge, UK) containing 100–200 ml of medium. Following stirring at 40 rpm, the cell viability is estimated with trypan blue. In another format, Fibra-Cel microcarriers (Bibby Sterlin, Stone, UK) (5 g/l) is employed as follows. A cell inoculum, resuspended in 5 ml of medium, is added to the carrier (50 ml) in a 250 ml Erlenmeyer flask and left stationary, with occasional agitation, for 1 to 4 h. The medium is then replaced with 50 ml of fresh medium and shaking initiated. For virus production, cells are allowed to grow to about 80% confluence, after which time the medium is replaced (to 25% of the final volume) and adenovirus added at an MOI of 0.05. Cultures are left stationary overnight, following which the volume is increased to 100% and shaking commenced for another 72 h.

Other than the requirement that the adenovirus vector be replication defective, or at least conditionally defective, the nature of the adenovirus vector is not believed to be crucial to the successful practice of the invention. The adenovirus may be of any of the 42 different known serotypes or subgroups A–F. Adenovirus type 5 of subgroup C is the preferred starting material in order to obtain a conditional replication-defective adenovirus vector for use in the present invention, since Adenovirus type 5 is a human adenovirus about which a great deal of biochemical and genetic information is known, and it has historically been used for most constructions employing adenovirus as a vector.

As stated above, the typical vector according to the present invention is replication defective and will not have an adenovirus E1 region. Thus, it will be most convenient to introduce the polynucleotide encoding the gene of interest at the position from which the E1-coding sequences have been removed. However, the position of insertion of the construct within the adenovirus sequences is not critical to the invention. The polynucleotide encoding the gene of interest may also be inserted in lieu of the deleted E3 region in E3 replacement vectors as described by Karlsson et al. (1986) or in the E4 region where a helper cell line or helper virus complements the E4 defect.

Adenovirus is easy to grow and manipulate and exhibits broad host range in vitro and in vivo. This group of viruses can be obtained in high titers, e.g., $10^9$–$10^{11}$ plaque-forming units per ml, and they are highly infective. The life cycle of adenovirus does not require integration into the host cell genome. The foreign genes delivered by adenovirus vectors are episomal and, therefore, have low genotoxicity to host cells. No side effects have been reported in studies of vaccination with wild-type adenovirus (Couch et al., 1963; Top et al., 1971), demonstrating their safety and therapeutic potential as in vivo gene transfer vectors.

Adenovirus vectors have been used in eukaryotic gene expression (Levrero et al., 1991; Gomez-Foix et al., 1992) and vaccine development (Grunhaus and Horwitz, 1992; Graham and Prevec, 1992). Recently, animal studies suggested that recombinant adenovirus could be used for gene therapy (Stratford-Perricaudet and Perricaudet, 1991; Stratford-Perricaudet et al., 1990; Rich et al., 1993). Studies in administering recombinant adenovirus to different tissues include trachea instillation (Rosenfeld et al., 1991; Rosenfeld et al., 1992), muscle injection (Ragot et al., 1993), peripheral intravenous injections (Herz and Gerard, 1993) and stereotactic inoculation into the brain (Le Gal La Salle et al., 1993).

2. Retroviruses

The retroviruses are a group of single-stranded RNA viruses characterized by an ability to convert their RNA to double-stranded DNA in infected cells by a process of reverse-transcription (Coffin, 1990). The resulting DNA then stably integrates into cellular chromosomes as a provirus and directs synthesis of viral proteins. The integration results in the retention of the viral gene sequences in the recipient cell and its descendants. The retroviral genome contains three genes, gag, pol, and env that code for capsid proteins, polymerase enzyme, and envelope components, respectively. A sequence found upstream from the gag gene contains a signal for packaging of the genome into virions. Two long terminal repeat (LTR) sequences are present at the 5' and 3' ends of the viral genome. These contain strong promoter and enhancer sequences and are also required for integration in the host cell genome (Coffin, 1990).

In order to construct a retroviral vector, a nucleic acid encoding one or more oligonucleotide or polynucleotide sequences of interest is inserted into the viral genome in the place of certain viral sequences to produce a virus that is replication-defective. In order to produce virions, a packaging cell line containing the gag, pol, and env genes but without the LTR and packaging components is constructed (Mann et al., 1983). When a recombinant plasmid containing a cDNA, together with the retroviral LTR and packaging sequences is introduced into this cell line (by calcium phosphate precipitation for example), the packaging sequence allows the RNA transcript of the recombinant plasmid to be packaged into viral particles, which are then secreted into the culture media (Nicolas and Rubenstein, 1988; Temin, 1986; Mann et al., 1983). The media containing the recombinant retroviruses is then collected, optionally concentrated, and used for gene transfer. Retroviral vectors are able to infect a broad variety of cell types. However, integration and stable expression require the division of host cells (Paskind et al., 1975).

A novel approach designed to allow specific targeting of retrovirus vectors was recently developed based on the chemical modification of a retrovirus by the chemical addition of lactose residues to the viral envelope. This modification could permit the specific infection of hepatocytes via sialoglycoprotein receptors.

A different approach to targeting of recombinant retroviruses was designed in which biotinylated antibodies against a retroviral envelope protein and against a specific cell receptor were used. The antibodies were coupled via the biotin components by using streptavidin (Roux et al., 1989). Using antibodies against major histocompatibility complex class I and class II antigens, they demonstrated the infection of a variety of human cells that bore those surface antigens with an ecotropic virus in vitro (Roux et al., 1989).

3. Adeno-Associated Viruses

AAV (Ridgeway, 1988; Hermonat and Muzycska, 1984) is a parovirus, discovered as a contamination of adenoviral stocks. It is a ubiquitous virus (antibodies are present in 85% of the US human population) that has not been linked to any disease. It is also classified as a dependovirus, because its replications is dependent on the presence of a helper virus, such as adenovirus. Five serotypes have been isolated, of which AAV-2 is the best characterized. AAV has a single-stranded linear DNA that is encapsidated into capsid proteins VP1, VP2 and VP3 to form an icosahedral virion of 20 to 24 nm in diameter (Muzyczka and McLaughlin, 1988).

The AAV DNA is approximately 4.7 kilobases long. It contains two open reading frames and is flanked by two ITRs (FIG. 2). There are two major genes in the AAV genome: rep and cap. The rep gene codes for proteins responsible for viral replications, whereas cap codes for capsid protein VP1–3. Each ITR forms a T-shaped hairpin structure. These terminal repeats are the only essential cis components of the AAV for chromosomal integration. Therefore, the AAV can be used as a vector with all viral coding sequences removed and replaced by the cassette of genes for delivery. Three viral promoters have been identified and named p5, p19, and p40, according to their map position. Transcription from p5 and p19 results in production of rep proteins, and transcription from p40 produces the capsid proteins (Hermonat and Muzyczka, 1984).

There are several factors that prompted researchers to study the possibility of using rAAV as an expression vector. One is that the requirements for delivering a gene to integrate into the host chromosome are surprisingly few. It is necessary to have the 145-bp ITRs, which are only 6% of the AAV genome. This leaves room in the vector to assemble a 4.5-kb DNA insertion. While this carrying capacity may prevent the AAV from delivering large genes, it is amply suited for delivering the antisense constructs of the present invention.

AAV is also a good choice of delivery vehicles due to its safety. There is a relatively complicated rescue mechanism: not only wild type adenovirus but also AAV genes are required to mobilize rAAV. Likewise, AAV is not pathogenic and not associated with any disease. The removal of viral coding sequences minimizes immune reactions to viral gene expression, and therefore, rAAV does not evoke an inflammatory response.

4. Other Viral Vectors as Expression Constructs

Other viral vectors may be employed as expression constructs in the present invention for the delivery of oligonucleotide or polynucleotide sequences to a host cell. Vectors derived from viruses such as vaccinia virus (Ridgeway, 1988; Coupar et al., 1988), lentiviruses, polio viruses and herpes viruses may be employed. They offer several attractive features for various mammalian cells (Friedmann, 1989; Ridgeway, 1988; Coupar et al., 1988; Horwich et al., 1990).

With the recent recognition of defective hepatitis B viruses, new insight was gained into the structure-function relationship of different viral sequences. In vitro studies showed that the virus could retain the ability for helper-dependent packaging and reverse transcription despite the deletion of up to 80% of its genome (Horwich et al., 1990). This suggested that large portions of the genome could be replaced with foreign genetic material. The hepatotropism and persistence (integration) were particularly attractive properties for liver-directed gene transfer. Chang et al. (1991) introduced the chloramphenicol acetyltransferase (CAT) gene into duck hepatitis B virus genome in the place of the polymerase, surface, and pre-surface coding sequences. It was cotransfected with wild-type virus into an avian hepatoma cell line. Culture media containing high titers of the recombinant virus were used to infect primary duckling hepatocytes. Stable CAT gene expression was detected for at least 24 days after transfection (Chang et al., 1991).

5. Non-Viral Vectors

In order to effect expression of the oligonucleotide or polynucleotide sequences of the present invention, the expression construct must be delivered into a cell. This delivery may be accomplished in vitro, as in laboratory procedures for transforming cells lines, or in vivo or ex vivo, as in the treatment of certain disease states. As described above, one preferred mechanism for delivery is via viral infection where the expression construct is encapsulated in an infectious viral particle.

Once the expression construct has been delivered into the cell the nucleic acid encoding the desired oligonucleotide or polynucleotide sequences may be positioned and expressed at different sites. In certain embodiments, the nucleic acid encoding the construct may be stably integrated into the genome of the cell. This integration may be in the specific location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle. How the expression construct is delivered to a cell and where in the cell the nucleic acid remains is dependent on the type of expression construct employed.

In certain embodiments of the invention, the expression construct comprising one or more oligonucleotide or polynucleotide sequences may simply consist of naked recombinant DNA or plasmids. Transfer of the construct may be performed by any of the methods mentioned above which physically or chemically permeabilize the cell membrane. This is particularly applicable for transfer in vitro but it may be applied to in vivo use as well. Dubensky et al. (1984) successfully injected polyomavirus DNA in the form of calcium phosphate precipitates into liver and spleen of adult and newborn mice demonstrating active viral replication and acute infection. Benvenisty and Reshef (1986) also demonstrated that direct intraperitoneal injection of calcium phosphate-precipitated plasmids results in expression of the transfected genes. It is envisioned that DNA encoding a gene of interest may also be transferred in a similar manner in vivo and express the gene product.

Another embodiment of the invention for transferring a naked DNA expression construct into cells may involve particle bombardment. This method depends on the ability to accelerate DNA-coated microprojectiles to a high velocity allowing them to pierce cell membranes and enter cells without killing them (Klein et al., 1987). Several devices for accelerating small particles have been developed. One such device relies on a high voltage discharge to generate an electrical current, which in turn provides the motive force (Yang et al., 1990). The microprojectiles used have consisted of biologically inert substances such as tungsten or gold beads.

Selected organs including the liver, skin, and muscle tissue of rats and mice have been bombarded in vivo (Yang et al., 1990; Zelenin et al., 1991). This may require surgical exposure of the tissue or cells, to eliminate any intervening tissue between the gun and the target organ, i.e., ex vivo treatment. Again, DNA encoding a particular gene may be delivered via this method and still be incorporated by the present invention.

Antisense Oligonucleotides

The end result of the flow of genetic information is the synthesis of protein. DNA is transcribed by polymerases into messenger RNA and translated on the ribosome to yield a folded, functional protein. Thus there are several steps along the route where protein synthesis can be inhibited. The native DNA segment coding for a polypeptide described herein, as all such mammalian DNA strands, has two strands: a sense strand and an antisense strand held together by hydrogen bonding. The messenger RNA coding for polypeptide has the same nucleotide sequence as the sense DNA strand except that the DNA thymidine is replaced by uridine. Thus, synthetic antisense nucleotide sequences will bind to a mRNA and inhibit expression of the protein encoded by that mRNA.

The targeting of antisense oligonucleotides to mRNA is thus one mechanism to shut down protein synthesis, and, consequently, represents a powerful and targeted therapeutic approach. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829, each specifically incorporated herein by reference in its entirety). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., 1988; Vasanthakumar and Ahmed, 1989; Peris et al., 1998; U.S. Pat. No. 5,801,154; U.S. Pat. No. 5,789,573; U.S. Pat. No. 5,718,709 and U.S. Pat. No. 5,610,288, each specifically incorporated herein by reference in its entirety). Antisense constructs have also been described that inhibit and can be used to treat a variety of abnormal cellular proliferations, e.g., cancer (U.S. Pat. No. 5,747,470; U.S. Pat. No. 5,591,317 and U.S. Pat. No. 5,783,683, each specifically incorporated herein by reference in its entirety).

Therefore, in exemplary embodiments, the invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein.

Selection of antisense compositions specific for a given gene sequence is based upon analysis of the chosen target sequence (i.e., in these illustrative examples the rat and human sequences) and determination of secondary structure, $T_m$, binding energy, relative stability, and antisense compositions were selected based upon their relative inability to form dimers, hairpins, or other secondary structures that would reduce or prohibit specific binding to the target mRNA in a host cell.

Highly preferred target regions of the mRNA, are those which are at or near the AUG translation initiation codon, and those sequences which were substantially complementary to 5' regions of the mRNA. These secondary structure analyses and target site selection considerations were performed using v.4 of the OLIGO primer analysis software (Rychlik, 1997) and the BLASTN 2.0.5 algorithm software (Altschul et al., 1997).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., 1997). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane (Morris et al., 1997).

Ribozymes

Although proteins traditionally have been used for catalysis of nucleic acids, another class of macromolecules has emerged as useful in this endeavor. Ribozymes are RNA-protein complexes that cleave nucleic acids in a site-specific fashion. Ribozymes have specific catalytic domains that possess endonuclease activity (Kim and Cech, 1987; Gerlach et al., 1987; Forster and Symons, 1987). For example, a large number of ribozymes accelerate phosphoester transfer reactions with a high degree of specificity, often cleaving only one of several phosphoesters in an oligonucleotide substrate (Cech et al., 1981; Michel and Westhof, 1990; Reinhold-Hurek and Shub, 1992). This specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, 1989; Cech et al., 1981). For example, U.S. Pat. No. 5,354,855 (specifically incorporated herein by reference) reports that certain ribozymes can act as endonucleases with a sequence specificity greater than that of known ribonucleases and approaching that of the DNA restriction enzymes. Thus, sequence-specific ribozyme-mediated inhibition of gene expression may be particularly suited to therapeutic applications (Scanlon et al., 1991; Sarver et al., 1990). Recently, it was reported that ribozymes elicited genetic changes in some cells lines to which they were applied; the altered genes included the oncogenes H-ras, c-fos and genes of HIV. Most of this work involved the modification of a target mRNA, based on a specific mutant codon that is cleaved by a specific ribozyme.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., 1992). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or Neurospora VS RNA motif. Examples of hammerhead motifs are described by Rossi et al. (1992). Examples of hairpin motifs are described by Hampel et al. (Eur. Pat. Appl. Publ. No. EP 0360257), Hampel and Tritz (1989), Hampel et al. (1990) and U.S. Pat. No. 5,631,359 (specifically incorporated herein by reference). An example of the hepatitis δ virus motif is described by Perrofta and Been (1992); an example of the RNaseP motif is described by Guerrier-Takada et al. (1983); Neurospora VS RNA ribozyme motif is described by Collins (Saville and Collins, 1990; Saville and Collins, 1991; Collins and Olive, 1993); and an example of the Group I intron is described in (U.S. Pat. No. 4,987,071, specifically incorporated herein by reference). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

In certain embodiments, it may be important to produce enzymatic cleaving agents which exhibit a high degree of specificity for the RNA of a desired target, such as one of the sequences disclosed herein. The enzymatic nucleic acid molecule is preferably targeted to a highly conserved sequence region of a target mRNA. Such enzymatic nucleic acid molecules can be delivered exogenously to specific cells as required. Alternatively, the ribozymes can be expressed from DNA or RNA vectors that are delivered to specific cells.

Small enzymatic nucleic acid motifs (e.g., of the hammerhead or the hairpin structure) may also be used for exogenous delivery. The simple structure of these molecules increases the ability of the enzymatic nucleic acid to invade targeted regions of the mRNA structure. Alternatively, catalytic RNA molecules can be expressed within cells from eukaryotic promoters (e.g., Scanlon et al., 1991; Kashani-Sabet et al., 1992; Dropulic et al., 1992; Weerasinghe et al., 1991; Ojwang et al., 1992; Chen et al., 1992; Sarver et al., 1990). Those skilled in the art realize that any ribozyme can be expressed in eukaryotic cells from the appropriate DNA vector. The activity of such ribozymes can be augmented by their release from the primary transcript by a second ribozyme (Int. Pat. Appl. Publ. No. WO 93/23569, and Int. Pat. Appl. Publ. No. WO 94/02595, both hereby incorporated by reference; Ohkawa et al., 1992; Taira et al., 1991; and Ventura et al., 1993).

Ribozymes may be added directly, or can be complexed with cationic lipids, lipid complexes, packaged within liposomes, or otherwise delivered to target cells. The RNA or RNA complexes can be locally administered to relevant tissues ex vivo, or in vivo through injection, aerosol inhalation, infusion pump or stent, with or without their incorporation in biopolymers.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Hammerhead or hairpin ribozymes may be individually analyzed by computer folding (Jaeger et al., 1989) to assess whether the ribozyme sequences fold into the appropriate secondary structure. Those ribozymes with unfavorable intramolecular interactions between the binding arms and the catalytic core are eliminated from consideration. Varying binding arm lengths can be chosen to optimize activity. Generally, at least 5 or so bases on each arm are able to bind to, or otherwise interact with, the target RNA.

Ribozymes of the hammerhead or hairpin motif may be designed to anneal to various sites in the mRNA message, and can be chemically synthesized. The method of synthesis used follows the procedure for normal RNA synthesis as described in Usman et al. (1987) and in Scaringe et al. (1990) and makes use of common nucleic acid protecting and coupling groups, such as dimethoxytrityl at the 5'-end, and phosphoramidites at the 3'-end. Average stepwise coupling yields are typically >98%. Hairpin ribozymes may be synthesized in two parts and annealed to reconstruct an active ribozyme (Chowrira and Burke, 1992). Ribozymes may be modified extensively to enhance stability by modification with nuclease resistant groups, for example, 2'-amino, 2'-C-allyl, 2'-flouro, 2'-o-methyl, 2'-H (for a review see, e.g., Usman and Cedergren, 1992). Ribozymes may be purified by gel electrophoresis using general methods or by high pressure liquid chromatography and resuspended in water.

Ribozyme activity can be optimized by altering the length of the ribozyme binding arms, or chemically synthesizing ribozymes with modifications that prevent their degradation by serum ribonucleases (see, e.g., Int. Pat. Appl. Publ. No. WO 92/07065; Perrault et al, 1990; Pieken et al., 1991; Usman and Cedergren, 1992; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells (Elroy-Stein and Moss, 1990; Gao and Huang, 1993; Lieber et al., 1993; Zhou et al., 1990). Ribozymes expressed from such promoters can function in mammalian cells (e.g., Kashani-Saber et al., 1992; Ojwang et al., 1992; Chen et al., 1992; Yu et al., 1993; L'Huillier et al., 1992; Lisziewicz et al., 1993). Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

Ribozymes may be used as diagnostic tools to examine genetic drift and mutations within diseased cells. They can also be used to assess levels of the target RNA molecule. The close relationship between ribozyme activity and the structure of the target RNA allows the detection of mutations in any region of the molecule which alters the base-pairing and three-dimensional structure of the target RNA. By using multiple ribozymes, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These studies will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes are well known in the art, and include detection of the presence of mRNA associated with an IL-5 related condition. Such RNA is detected by determining the presence of a cleavage product after treatment with a ribozyme using standard methodology.

Peptide Nucleic Acids

In certain embodiments, the inventors contemplate the use of peptide nucleic acids (PNAs) in the practice of the methods of the invention. PNA is a DNA mimic in which the nucleobases are attached to a pseudopeptide backbone (Good and Nielsen, 1997). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (1997) and is incorporated herein by reference. As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., 1991; Hanvey et al., 1992; Hyrup and Nielsen, 1996; Neilsen, 1996). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc (Dueholm et al., 1994) or Fmoc (Thomson et al., 1995) protocols for solid-phase peptide synthesis, although other methods, including a modified Merrifield method, have been used (Christensen et al., 1995).

PNA monomers or ready-made oligomers are commercially available from PerSeptive Biosystems (Framingham, Mass.). PNA syntheses by either Boc or Fmoc protocols are straightforward using manual or automated protocols (Norton et al., 1995). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography (Norton et al., 1995) providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (Norton et al., 1995; Haaima et al., 1996; Stetsenko et al., 1996; Petersen et al., 1995; Ulmann et al., 1996; Koch et al., 1995; Orum et al., 1995; Footer et al., 1996; Griffith et al., 1995; Kremsky et al., 1996; Pardridge et al., 1995; Boffa et al., 1995; Landsdorp et al., 1996; Gambacorti-Passerini et al., 1996; Armitage et al., 1997; Seeger et al., 1997; Ruskowski et al., 1997). U.S. Pat. No. 5,700,922 discusses PNA-DNA-PNA chimeric molecules and their uses in diagnostics, modulating protein in organisms, and treatment of conditions susceptible to therapeutics.

In contrast to DNA and RNA, which contain negatively charged linkages, the PNA backbone is neutral. In spite of this dramatic alteration, PNAs recognize complementary DNA and RNA by Watson-Crick pairing (Egholm et al., 1993), validating the initial modeling by Nielsen et al. (1991). PNAs lack 3' to 5' polarity and can bind in either parallel or antiparallel fashion, with the antiparallel mode being preferred (Egholm et al., 1993).

Hybridization of DNA oligonucleotides to DNA and RNA is destabilized by electrostatic repulsion between the negatively charged phosphate backbones of the complementary strands. By contrast, the absence of charge repulsion in PNA-DNA or PNA-RNA duplexes increases the melting temperature ($T_m$) and reduces the dependence of $T_m$ on the concentration of mono- or divalent cations (Nielsen et al., 1991). The enhanced rate and affinity of hybridization are significant because they are responsible for the surprising ability of PNAs to perform strand invasion of complementary sequences within relaxed double-stranded DNA. In addition, the efficient hybridization at inverted repeats suggests that PNAs can recognize secondary structure effectively within double-stranded DNA. Enhanced recognition also occurs with PNAs immobilized on surfaces, and Wang et al. have shown that support-bound PNAs can be used to detect hybridization events (Wang et al., 1996).

One might expect that tight binding of PNAs to complementary sequences would also increase binding to similar (but not identical) sequences, reducing the sequence specificity of PNA recognition. As with DNA hybridization, however, selective recognition can be achieved by balancing oligomer length and incubation temperature. Moreover, selective hybridization of PNAs is encouraged by PNA-DNA hybridization being less tolerant of base mismatches than DNA-DNA hybridization. For example, a single mismatch within a 16 bp PNA-DNA duplex can reduce the $T_m$ by up to 15° C. (Egholm et al., 1993). This high level of discrimination has allowed the development of several PNA-based strategies for the analysis of point mutations (Wang et al., 1996; Carlsson et al., 1996; Thiede et al., 1996; Webb and Hurskainen, 1996; Perry-O'Keefe et al., 1996).

High-affinity binding provides clear advantages for molecular recognition and the development of new applications for PNAs. For example, 11–13 nucleotide PNAs inhibit the activity of telomerase, a ribonucleo-protein that extends telomere ends using an essential RNA template, while the analogous DNA oligomers do not (Norton et al., 1996).

Neutral PNAs are more hydrophobic than analogous DNA oligomers, and this can lead to difficulty solubilizing them at neutral pH, especially if the PNAs have a high purine content or if they have the potential to form secondary structures. Their solubility can be enhanced by attaching one or more positive charges to the PNA termini (Nielsen et al., 1991).

Findings by Allfrey and colleagues suggest that strand invasion will occur spontaneously at sequences within chromosomal DNA (Boffa et al., 1995; Boffa et al., 1996). These studies targeted PNAs to triplet repeats of the nucleotides CAG and used this recognition to purify transcriptionally active DNA (Boffa et al., 1995) and to inhibit transcription (Boffa et al., 1996). This result suggests that if PNAs can be delivered within cells then they will have the potential to be general sequence-specific regulators of gene expression.

Studies and reviews concerning the use of PNAs as antisense and anti-gene agents include Nielsen et al. (1993b), Hanvey et al. (1992), and Good and Nielsen (1997). Koppelhus et al. (1997) have used PNAs to inhibit HIV-1 inverse transcription, showing that PNAs may be used for antiviral therapies.

Methods of characterizing the antisense binding properties of PNAs are discussed in Rose (1993) and Jensen et al. (1997). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs include use in DNA strand invasion (Nielsen et al., 1991), antisense inhibition (Hanvey et al., 1992), mutational analysis (Orum et al., 1993), enhancers of transcription (Mollegaard et al., 1994), nucleic acid purification (Orum et al., 1995), isolation of transcriptionally active genes (Boffa et al., 1995), blocking of transcription factor binding (Vickers et al., 1995), genome cleavage (Veselkov et al., 1996), biosensors (Wang et al., 1996), in situ hybridization (Thisted et al., 1996), and in a alternative to Southern blotting (Perry-O'Keefe, 1996).

Polypeptide Compositions

The present invention, in other aspects, provides polypeptide compositions. Generally, a polypeptide of the invention will be an isolated polypeptide (or an epitope, variant, or active fragment thereof) derived from HSV. Preferably, the polypeptide is encoded by a polynucleotide sequence disclosed herein or a sequence which hybridizes under moderate or highly stringent conditions to a polynucleotide sequence disclosed herein. Alternatively, the polypeptide may be defined as a polypeptide which comprises a contiguous amino acid sequence from an amino acid sequence disclosed herein, or which polypeptide comprises an entire amino acid sequence disclosed herein.

In the present invention, a polypeptide composition is also understood to comprise one or more polypeptides that are immunologically reactive with antibodies and/or T cells generated against a polypeptide of the invention, particularly a polypeptide having amino acid sequences disclosed herein, or to active fragments, or to variants or biological functional equivalents thereof.

Likewise, a polypeptide composition of the present invention is understood to comprise one or more polypeptides that are capable of eliciting antibodies or T cells that are immunologically reactive with one or more polypeptides encoded by one or more contiguous nucleic acid sequences contained in the amino acid sequences disclosed herein, or to active fragments, or to variants thereof, or to one or more nucleic acid sequences which hybridize to one or more of these sequences under conditions of moderate to high stringency. Particularly illustrative polypeptides comprise the amino acid sequence disclosed in SEQ ID NO: 2, 3, 5, 6, 7, 10–12, 14–15, 17–18, 20–23, 25–33, 39–47, 50–51, 54–64, 74–75, 90–97, 120–121, 122–140, 142–143, 153–178, 181, 195–205, 211–212, 215–216, 227–239, 241, 243, 248–250, and 253–254.

As used herein, an active fragment of a polypeptide includes a whole or a portion of a polypeptide which is modified by conventional techniques, e.g., mutagenesis, or by addition, deletion, or substitution, but which active fragment exhibits substantially the same structure function, antigenicity, etc., as a polypeptide as described herein.

In certain illustrative embodiments, the polypeptides of the invention will comprise at least an immunogenic portion of an HSV antigen or a variant or biological functional equivalent thereof, as described herein. Polypeptides as described herein may be of any length. Additional sequences derived from the native protein and/or heterologous sequences may be present, and such sequences may (but need not) possess further immunogenic or antigenic properties.

An "immunogenic portion," as used herein is a portion of a protein that is recognized (i.e., specifically bound) by a B-cell and/or T-cell surface antigen receptor. Such immunogenic portions generally comprise at least 5 amino acid residues, more preferably at least 10, and still more preferably at least 20 amino acid residues of an HSV protein or a variant thereof. Certain preferred immunogenic portions include peptides in which an N-terminal leader sequence and/or transmembrane domain have been deleted. Other preferred immunogenic portions may contain a small N- and/or C-terminal deletion (e.g., 1–30 amino acids, preferably 5–15 amino acids), relative to the mature protein.

Immunogenic portions may generally be identified using well known techniques, such as those summarized in Paul, *Fundamental Immunology*, 3rd ed., 243–247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well known techniques. An immunogenic portion of a native HSV protein is a portion that reacts with such antisera and/or T-cells at a level that is not substantially less than the reactivity of the full length polypeptide (e.g., in an ELISA and/or T-cell reactivity assay). Such immunogenic portions may react within such assays at a level that is similar to or greater than the reactivity of the full length polypeptide. Such screens may generally be performed using methods well known to those of ordinary skill in the art, such as those described in Harlow and Lane, *Antibodies: A Laboratory Manual*, Cold Spring Harbor Laboratory, 1988. For example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As noted above, a composition may comprise a variant of a native HSV protein. A polypeptide "variant," as used herein, is a polypeptide that differs from a native HSV protein in one or more substitutions, deletions, additions and/or insertions, such that the immunogenicity of the polypeptide is not substantially diminished. In other words, the ability of a variant to react with antigen-specific antisera may be enhanced or unchanged, relative to the native protein, or may be diminished by less than 50%, and preferably less than 20%, relative to the native protein. Such variants may generally be identified by modifying one of the above polypeptide sequences and evaluating the reactivity of the modified polypeptide with antigen-specific antibodies or antisera as described herein. Preferred variants include those in which one or more portions, such as an N-terminal leader sequence or transmembrane domain, have been removed. Other preferred variants include variants in which a small portion (e.g., 1–30 amino acids, preferably 5–15 amino acids) has been removed from the N- and/or C-terminal of the mature protein.

Polypeptide variants encompassed by the present invention include those exhibiting at least about 70%, 75%, 80%, 85%, 90%, 91%, 92%, 93%, 94%, 95%, 96%, 97%, 98%, or 99% or more identity (determined as described above) to the polypeptides disclosed herein.

Preferably, a variant contains conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gin, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

Polypeptides may be prepared using any of a variety of well known techniques. Recombinant polypeptides encoded by DNA sequences as described above may be readily prepared from the DNA sequences using any of a variety of expression vectors known to those of ordinary skill in the art. Expression may be achieved in any appropriate host cell that has been transformed or transfected with an expression vector containing a DNA molecule that encodes a recombinant polypeptide. Suitable host cells include prokaryotes, yeast, and higher eukaryotic cells, such as mammalian cells and plant cells. Preferably, the host cells employed are *E. coli*, yeast or a mammalian cell line such as COS or CHO. Supernatants from suitable host/vector systems which secrete recombinant protein or polypeptide into culture media may be first concentrated using a commercially available filter. Following concentration, the concentrate may be applied to a suitable purification matrix such as an affinity matrix or an ion exchange resin. Finally, one or more reverse phase HPLC steps can be employed to further purify a recombinant polypeptide.

Portions and other variants having less than about 100 amino acids, and generally less than about 50 amino acids, may also be generated by synthetic means, using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied BioSystems Division (Foster City, Calif.), and may be operated according to the manufacturer's instructions.

Within certain specific embodiments, a polypeptide may be a fusion protein that comprises multiple polypeptides as described herein, or that comprises at least one polypeptide as described herein and an unrelated sequence, such as a known protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein.

Fusion proteins may generally be prepared using standard techniques, including chemical conjugation. Preferably, a fusion protein is expressed as a recombinant protein, allowing the production of increased levels, relative to a non-fused protein, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion protein that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39–46, 1985; Murphy et al., *Proc. Natl. Acad. Sci. USA* 83:8258–8262,1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

Fusion proteins are also provided. Such proteins comprise a polypeptide as described herein together with an unrelated immunogenic protein. Preferably the immunogenic protein is capable of eliciting a recall response. Examples of such proteins include tetanus, tuberculosis and hepatitis proteins (see, for example, Stoute et al. *New Engl. J. Med.*, 336:86–91, 1997).

Within preferred embodiments, an immunological fusion partner is derived from protein D, a surface protein of the gram-negative bacterium *Haemophilus influenza* B (WO 91/18926). Preferably, a protein D derivative comprises approximately the first third of the protein (e.g., the first N-terminal 100–110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenzae virus, NS1 (hemaglutinin). Typically, the N-terminal 81 amino acids are used, although different fragments that include T-helper epitopes may be used.

In another embodiment, a *Mycobacterium tuberculosis*-derived Ra12 polynucleotide is linked to at least an immunogenic portion of an HSV polynucleotide of this invention. Ra12 compositions and methods for their use in enhancing expression of heterologous polynucleotide sequences is described in U.S. Patent Application 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been disclosed (U.S. Patent Application 60/158,585; see also, Skeiky et al., *Infection and Immun.* (1999) 67:3998–4007, incorporated herein by reference). The Ra12 C-terminal fragment of the MTB32A coding sequence expresses at high levels on its own and remains as a soluble protein throughout the purification process. Moreover, the presence of Ra12 polypeptide fragments in a fusion polypeptide may enhance the immunogenicity of the heterologous antigenic HSV polypeptides with which Ra12 is fused. In one embodiment, the Ra12 polypeptide sequence present in a fusion polypeptide with an HSV antigen comprises some or all of amino acid residues 192 to 323 of MTB32A.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265–292,1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795–798, 1992). Within a preferred embodiment, a repeat portion of LYTA may be incorporated into a fusion protein. A repeat portion is found in the C-terminal region starting at residue 178. A particularly preferred repeat portion incorporates residues 188–305.

In general, polypeptides (including fusion proteins) and polynucleotides as described herein are isolated. An "isolated" polypeptide or polynucleotide is one that is removed from its original environment. For example, a naturally-occurring protein is isolated if it is separated from some or all of the coexisting materials in the natural system. Preferably, such polypeptides are at least about 90% pure, more preferably at least about 95% pure and most preferably at least about 99% pure. A polynucleotide is considered to be isolated if, for example, it is cloned into a vector that is not a part of the natural environment.

Binding Agents

The present invention further provides agents, such as antibodies and antigen-binding fragments thereof, that specifically bind to a HSV protein. As used herein, an antibody, or antigen-binding fragment thereof, is said to "specifically bind" to a HSV protein if it reacts at a detectable level (within, for example, an ELISA) with a HSV protein, and does not react detectably with unrelated proteins under similar conditions. As used herein, "binding" refers to a noncovalent association between two separate molecules such that a complex is formed. The ability to bind may be evaluated by, for example, determining a binding constant for the formation of the complex. The binding constant is the value obtained when the concentration of the complex is divided by the product of the component concentrations. In general, two compounds are said to "bind," in the context of the present invention, when the binding constant for complex formation exceeds about $10^3$ L/mol. The binding constant may be determined using methods well known in the art.

Binding agents may be further capable of differentiating between patients with and without HSV infection using the representative assays provided herein. For example, preferably, antibodies or other binding agents that bind to a HSV protein will generate a signal indicating the presence of infection in at least about 20% of patients with the disease, and will generate a negative signal indicating the absence of the disease in at least about 90% of individuals without an HSV infection. To determine whether a binding agent satisfies this requirement, biological samples (e.g., blood, sera, sputum, urine and/or biopsies) from patients with and without HSV (as determined using standard clinical tests) may be assayed as described herein for the presence of polypeptides that bind to the binding agent. It will be apparent that a statistically significant number of samples with and without the disease should be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988) and digested by papain to yield Fab and Fc fragments. The Fab and Fc fragments may be separated by affinity chromatography on protein A bead columns.

Monoclonal antibodies of the present invention may be coupled to one or more therapeutic agents. Suitable agents in this regard include radionuclides, differentiation inducers, drugs, toxins, and derivatives thereof. Preferred radionuclides include $^{90}Y$, $^{123}I$, $^{125}I$, $^{131}I$, $^{186}Re$, $^{188}Re$, $^{211}At$, and $^{212}Bi$. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No.

4,673,562, to Davison et al. discloses representative chelating compounds and their synthesis.

A variety of routes of administration for the antibodies and immunoconjugates may be used. Typically, administration will be intravenous, intramuscular, subcutaneous and the like. It will be evident that the precise dose of the antibody/immunoconjugate will vary depending upon the antibody used, the antigen density, and the rate of clearance of the antibody.

T Cells

Immunotherapeutic compositions may also, or alternatively, comprise T cells specific for HSV protein. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a HSV polypeptide, polynucleotide encoding a HSV polypeptide and/or an antigen presenting cell (APC) that expresses such a polypeptide. Such stimulation is performed under conditions and for a time sufficient to permit the generation of T cells that are specific for the polypeptide. In certain embodiments, HSV polypeptide or polynucleotide is present within a delivery vehicle, such as a microsphere, to facilitate the generation of specific T cells.

T cells are considered to be specific for a HSV polypeptide if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., *Cancer Res.* 54:1065–1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a HSV polypeptide (100 ng/ml –100 μg/ml, preferably 200 ng/ml –25 μg/ml) for 3–7 days should result in at least a two fold increase in proliferation of the T cells. Contact as described above for 2–3 hours should result in activation of the T cells, as measured using standard cytokine assays in which a two fold increase in the level of cytokine release (e.g., TNF or IFN-γ) is indicative of T cell activation (see Coligan et al., Current Protocols in Immunology, vol. 1, Wiley Interscience (Greene 1998)). T cells that have been activated in response to a HSV polypeptide, polynucleotide or polypeptide-expressing APC may be $CD4^+$ and/or $CD8^+$. HSV protein-specific T cells may be expanded using standard techniques. Within preferred embodiments, the T cells are derived from a patient, a related donor or an unrelated donor, and are administered to the patient following stimulation and expansion.

For therapeutic purposes, $CD4^+$ or $CD8^+$ T cells that proliferate in response to a HSV polypeptide, polynucleotide or APC can be expanded in number either in vitro or in vivo. Proliferation of such T cells in vitro may be accomplished in a variety of ways. For example, the T cells can be re-exposed to a HSV polypeptide, or a short peptide corresponding to an immunogenic portion of such a polypeptide, with or without the addition of T cell growth factors, such as interleukin-2, and/or stimulator cells that synthesize a HSV polypeptide. Alternatively, one or more T cells that proliferate in the presence of a HSV protein can be expanded in number by cloning. Methods for cloning cells are well known in the art, and include limiting dilution.

Pharmaceutical Compositions

In additional embodiments, the present invention concerns formulation of one or more of the polynucleotide, polypeptide, T-cell and/or antibody compositions disclosed herein in pharmaceutically-acceptable solutions for administration to a cell or an animal, either alone, or in combination with one or more other modalities of therapy.

It will also be understood that, if desired, the nucleic acid segment, RNA, DNA or PNA compositions that express a polypeptide as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Formulation of pharmaceutically-acceptable excipients and carrier solutions is well-known to those of skill in the art, as is the development of suitable dosing and treatment regimens for using the particular compositions described herein in a variety of treatment regimens, including e.g., oral, parenteral, intravenous, intranasal, and intramuscular administration and formulation.

1. Oral Delivery

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (Mathiowitz et al., 1997; Hwang et al., 1998; U.S. Pat. No. 5,641,515; U.S. Pat. No. 5,580,579 and U.S. Pat. No. 5,792,451, each specifically incorporated herein by reference in its entirety). The tablets, troches, pills, capsules and the like may also contain the following: a binder, as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. A syrup of elixir may contain the active compound sucrose as a sweetening agent methyl and propylparabens as preservatives, a dye and flavoring, such as cherry or orange flavor. Of course, any material used in preparing any dosage unit form should be pharmaceutically pure and substantially non-toxic in the amounts employed. In addition, the active compounds may be incorporated into sustained-release preparation and formulations.

Typically, these formulations may contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration the compositions of the present invention may alternatively be incorporated with one or more excipients in the form of a mouthwash, dentifrice, buccal tablet, oral spray, or sublingual orally-administered formulation. For example, a mouthwash may be prepared incorporating the active ingredient in the required amount in an appropriate solvent, such as a sodium borate solution (Dobell's Solution). Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

2. Injectable Delivery

In certain circumstances it will be desirable to deliver the pharmaceutical compositions disclosed herein parenterally, intravenously, intramuscularly, or even intraperitoneally as described in U.S. Pat. No. 5,543,158; U.S. Pat. No. 5,641,515 and U.S. Pat. No. 5,399,363 (each specifically incorporated herein by reference in its entirety). Solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations contain a preservative to prevent the growth of microorganisms.

The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For parenteral administration in an aqueous solution, for example, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035–1038 and 1570–1580). Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by FDA Office of Biologics standards.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The compositions disclosed herein may be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions.

The phrase "pharmaceutically-acceptable" refers to molecular entities and compositions that do not produce an allergic or similar untoward reaction when administered to a human. The preparation of an aqueous composition that contains a protein as an active ingredient is well understood in the art. Typically, such compositions are prepared as injectables, either as liquid solutions or suspensions; solid forms suitable for solution in, or suspension in, liquid prior to injection can also be prepared. The preparation can also be emulsified.

3. Nasal Delivery

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described e.g., in U.S. Pat. No. 5,756,353 and U.S. Pat. No. 5,804,212 (each specifically incorporated herein by reference in its entirety). Likewise, the delivery of drugs using intranasal microparticle resins (Takenaga et al., 1998) and lysophosphatidylglycerol compounds (U.S. Pat. No. 5,725,871, specifically incorporated herein by reference in its entirety) are also well-known in the pharmaceutical arts. Likewise, transmucosal drug delivery in the form of a polytetrafluoroetheylene support matrix is described in U.S. Pat. No. 5,780,045 (specifically incorporated herein by reference in its entirety).

4. Liposome-, Nanocapsule-, and Microparticle-Mediated Delivery

In certain embodiments, the inventors contemplate the use of liposomes, nanocapsules, microparticles, microspheres, lipid particles, vesicles, and the like, for the introduction of the compositions of the present invention into suitable host cells. In particular, the compositions of the present invention may be formulated for delivery either encapsulated in a lipid particle, a liposome, a vesicle, a nanosphere, or a nanoparticle or the like.

Such formulations may be preferred for the introduction of pharmaceutically-acceptable formulations of the nucleic acids or constructs disclosed herein. The formation and use of liposomes is generally known to those of skill in the art (see for example, Couvreur et al., 1977; Couvreur, 1988; Lasic, 1998; which describes the use of liposomes and nanocapsules in the targeted antibiotic therapy for intracellular bacterial infections and diseases). Recently, liposomes were developed with improved serum stability and circulation half-times (Gabizon and Papahadjopoulos, 1988; Allen and Choun, 1987; U.S. Pat. No. 5,741,516, specifically incorporated herein by reference in its entirety). Further, various methods of liposome and liposome like preparations as potential drug carriers have been reviewed (Takakura, 1998; Chandran et al., 1997; Margalit, 1995; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally resistant to transfection by other procedures including T cell suspensions, primary hepatocyte cultures and PC 12 cells (Renneisen et al., 1990; Muller et al., 1990). In addition, liposomes are free of the DNA length constraints that are typical of viral-based delivery systems. Liposomes have been used effectively to introduce genes, drugs (Heath and Martin, 1986; Heath et al., 1986; Balazsovits et al., 1989; Fresta and Puglisi, 1996), radiotherapeutic agents (Pikul et al., 1987), enzymes (Imaizumi et al., 1990a; Imaizumi et al., 1990b), viruses (Faller and Baltimore, 1984), transcription factors and allosteric effectors (Nicolau and Gersonde, 1979) into a variety of cultured cell lines and animals. In addition, several successful clinical trails examining the effectiveness of liposome-mediated drug delivery have been completed (Lopez-Berestein et al., 1985a; 1985b; Coune, 1988; Sculier et al., 1988). Furthermore, several studies suggest that the use of liposomes is not associated with autoimmune responses, toxicity or gonadal localization after systemic delivery (Mori and Fukatsu, 1992).

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 $\mu$m. Sonication of MLVs results in the formation of small unilamellar vesicles (SUVs) with diameters in the range of 200 to 500 Å, containing an aqueous solution in the core.

Liposomes bear resemblance to cellular membranes and are contemplated for use in connection with the present invention as carriers for the peptide compositions. They are widely suitable as both water- and lipid-soluble substances can be entrapped, i.e., in the aqueous spaces and within the bilayer itself, respectively. It is possible that the drug-bearing liposomes may even be employed for site-specific delivery of active agents by selectively modifying the liposomal formulation.

In addition to the teachings of Couvreur et al. (1977; 1988), the following information may be utilized in generating liposomal formulations. Phospholipids can form a variety of structures other than liposomes when dispersed in water, depending on the molar ratio of lipid to water. At low ratios the liposome is the preferred structure. The physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

In addition to temperature, exposure to proteins can alter the permeability of liposomes. Certain soluble proteins, such as cytochrome c, bind, deform and penetrate the bilayer, thereby causing changes in permeability. Cholesterol inhibits this penetration of proteins, apparently by packing the phospholipids more tightly. It is contemplated that the most useful liposome formations for antibiotic and inhibitor delivery will contain cholesterol.

The ability to trap solutes varies between different types of liposomes. For example, MLVs are moderately efficient at trapping solutes, but SUVs are extremely inefficient. SUVs offer the advantage of homogeneity and reproducibility in size distribution, however, and a compromise between size and trapping efficiency is offered by large unilamellar vesicles (LUVs). These are prepared by ether evaporation and are three to four times more efficient at solute entrapment than MLVs.

In addition to liposome characteristics, an important determinant in entrapping compounds is the physicochemical properties of the compound itself. Polar compounds are trapped in the aqueous spaces and nonpolar compounds bind to the lipid bilayer of the vesicle. Polar compounds are released through permeation or when the bilayer is broken, but nonpolar compounds remain affiliated with the bilayer unless it is disrupted by temperature or exposure to lipoproteins. Both types show maximum efflux rates at the phase transition temperature.

Liposomes interact with cells via four different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. It often is difficult to determine which mechanism is operative and more than one may operate at the same time.

The fate and disposition of intravenously injected liposomes depend on their physical properties, such as size, fluidity, and surface charge. They may persist in tissues for h or days, depending on their composition, and half lives in the blood range from min to several h. Larger liposomes, such as MLVs and LUVs, are taken up rapidly by phagocytic cells of the reticuloendothelial system, but physiology of the circulatory system restrains the exit of such large species at most sites. They can exit only in places where large openings or pores exist in the capillary endothelium, such as the sinusoids of the liver or spleen. Thus, these organs are the predominate site of uptake. On the other hand, SUVs show a broader tissue distribution but still are sequestered highly in the liver and spleen. In general, this in vivo behavior limits the potential targeting of liposomes to only those organs and tissues accessible to their large size. These include the blood, liver, spleen, bone marrow, and lymphoid organs.

Targeting is generally not a limitation in terms of the present invention. However, should specific targeting be desired, methods are available for this to be accomplished. Antibodies may be used to bind to the liposome surface and to direct the antibody and its drug contents to specific antigenic receptors located on a particular cell-type surface. Carbohydrate determinants (glycoprotein or glycolipid cell-surface components that play a role in cell-cell recognition, interaction and adhesion) may also be used as recognition sites as they have potential in directing liposomes to particular cell types. Mostly, it is contemplated that intravenous injection of liposomal preparations would be used, but other routes of administration are also conceivable.

Alternatively, the invention provides for pharmaceutically-acceptable nanocapsule formulations of the compositions of the present invention. Nanocapsules can generally entrap compounds in a stable and reproducible way (Henry-Michelland et al., 1987; Quintanar-Guerrero et al., 1998; Douglas et al., 1987). To avoid side effects due to intracellular polymeric overloading, such ultrafine particles (sized around 0.1 µm) should be designed using polymers able to be degraded in vivo. Biodegradable polyalkylcyanoacrylate nanoparticles that meet these requirements are contemplated for use in the present invention. Such particles may be are easily made, as described (Couvreur et al., 1980; 1988; zur Muhlen et al., 1998; Zambaux et al. 1998; Pinto-Alphandry et al., 1995 and U.S. Pat. No. 5,145,684, specifically incorporated herein by reference in its entirety).

Vaccines

In certain preferred embodiments of the present invention, vaccines are provided. The vaccines will generally comprise one or more pharmaceutical compositions, such as those discussed above, in combination with an immunostimulant. An immunostimulant may be any substance that enhances or potentiates an immune response (antibody and/or cell-mediated) to an exogenous antigen. Examples of immunostimulants include adjuvants, biodegradable microspheres (e.g., polylactic galactide) and liposomes (into which the compound is incorporated; see, e.g., Fullerton, U.S. Pat. No. 4,235,877). Vaccine preparation is generally described in, for example, M. F. Powell and M. J. Newman, eds., "Vaccine Design (the subunit and adjuvant approach)," Plenum Press (NY, 1995). Pharmaceutical compositions and vaccines within the scope of the present invention may also contain other compounds, which may be biologically active or inactive. For example, one or more immunogenic portions of other HSV antigens may be present, either incorporated into a fusion polypeptide or as a separate compound, within the composition or vaccine.

Illustrative vaccines may contain DNA encoding one or more of the polypeptides as described above, such that the polypeptide is generated in situ. As noted above, the DNA may be present within any of a variety of delivery systems known to those of ordinary skill in the art, including nucleic acid expression systems, bacteria and viral expression systems. Numerous gene delivery techniques are well known in the art, such as those described by Rolland, *Crit. Rev. Therap. Drug Carrier Systems* 15:143–198, 1998, and references cited therein. Appropriate nucleic acid expression systems contain the necessary DNA sequences for expression in the patient (such as a suitable promoter and terminating signal). Bacterial delivery systems involve the administration of a bacterium (such as *Bacillus-Calmette-Guerrin*) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., *Proc. Natl. Acad. Sci. USA* 86:317–321, 1989; Flexner et al., *Ann. N.Y. Acad. Sci.* 569:86–103, 1989; Flexner et al., *Vaccine* 8:17–21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616–627, 1988; Rosenfeld et al., *Science* 252:431–434, 1991; Kolls et al., *Proc. Natl. Acad. Sci. USA* 91:215–219, 1994; Kass-Eisler et al., *Proc. Natl. Acad. Sci. USA* 90:11498–11502, 1993; Guzman et al., *Circulation* 88:2838–2848, 1993; and Guzman et al., *Cir. Res.* 73:1202–1207, 1993. Techniques for incorporating DNA into such expression systems are well known to those of ordinary skill in the art. The DNA may also be "naked," as described, for example, in Ulmer et al., *Science* 259:1745–1749, 1993 and reviewed by Cohen, *Science* 259:1691–1692, 1993. The uptake of naked DNA may be increased by coating the DNA onto biodegradable beads, which are efficiently transported into the cells. It will be apparent that a vaccine may comprise both a polynucleotide and a polypeptide component. Such vaccines may provide for an enhanced immune response.

It will be apparent that a vaccine may contain pharmaceutically acceptable salts of the polynucleotides and polypeptides provided herein. Such salts may be prepared from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

While any suitable carrier known to those of ordinary skill in the art may be employed in the vaccine compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344 and 5,942,252. Modified hepatitis B core protein carrier systems are also suitable, such as those described in WO/99 40934, and references cited therein, all incorporated herein by reference. One may also employ a carrier comprising the particulate-protein complexes described in U.S. Pat. No. 5,928,647, which are capable of inducing a class I-restricted cytotoxic T lymphocyte responses in a host.

Such compositions may also comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate. Compounds may also be encapsulated within liposomes using well known technology.

Any of a variety of immunostimulants may be employed in the vaccines of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

Within the vaccines provided herein, the adjuvant composition is preferably designed to induce an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145–173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montamide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties. Other preferred adjuvants comprise polyoxyethylene ethers, such as those described in WO 99/52549A1.

Any vaccine provided herein may be prepared using well known methods that result in a combination of antigen, immune response enhancer and a suitable carrier or excipient. The compositions described herein may be administered as part of a sustained release formulation (i.e., a formulation such as a capsule, sponge or gel (composed of polysaccharides, for example) that effects a slow release of compound following administration). Such formulations may generally be prepared using well known technology (see, e.g., Coombes et al., *Vaccine* 14:1429–1438, 1996) and administered by, for example, oral, rectal or subcutaneous implantation, or by implantation at the desired target site. Sustained-release formulations may contain a polypeptide, polynucleotide or antibody dispersed in a carrier matrix and/or contained within a reservoir surrounded by a rate controlling membrane.

Carriers for use within such formulations are biocompatible, and may also be biodegradable; preferably the formulation provides a relatively constant level of active component release. Such carriers include microparticles of poly(lactide-co-glycolide), polyacrylate, latex, starch, cellulose, dextran and the like. Other delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see, e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and vaccines to facilitate production of an antigen-specific immune response that targets HSV-infected cells. Delivery vehicles include antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-HSV effects per se and/or to be immunologically compatible with the receiver (i.e., matched HLA haplotype). APCs may generally be isolated from any of a variety of biological fluids and organs and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, *Nature* 392:245–251, 1998) and have been shown to be effective as a physiological adjuvant for eliciting prophylactic or therapeutic immunity (see Timmerman and Levy, *Ann. Rev. Med.* 50:507–529, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., *Nature Med.* 4:594–600, 1998).

Dendritic cells and progenitors may be obtained from peripheral blood, bone marrow, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4–1BB).

APCs may generally be transfected with a polynucleotide encoding a HSV protein (or portion or other variant thereof) such that the HSV polypeptide, or an immunogenic portion thereof, is expressed on the cell surface. Such transfection may take place ex vivo, and a composition or vaccine comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456–460, 1997. Antigen loading of dendritic cells may be achieved by incubating dendritic cells or progenitor cells with the HSV polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

Vaccines and pharmaceutical compositions may be presented in unit-dose or multi-dose containers, such as sealed ampoules or vials. Such containers are preferably hermetically sealed to preserve sterility of the formulation until use. In general, formulations may be stored as suspensions, solutions or emulsions in oily or aqueous vehicles. Alternatively, a vaccine or pharmaceutical composition may be stored in a freeze-dried condition requiring only the addition of a sterile liquid carrier immediately prior to use.

Immunotherapeutic Applications

In further aspects of the present invention, the compositions described herein may be used for immunotherapy of HSV infections. Within such methods, pharmaceutical compositions and vaccines are typically administered to a patient. As used herein, a "patient" refers to any warm-blooded animal, preferably a human. The above pharmaceutical compositions and vaccines may be used to prophylactically prevent or ameliorate the extent of infection by HSV or to treat a patient already infected with HSV. Administration may be by any suitable method, including administration by intravenous, intraperitoneal, intramuscular, subcutaneous, intranasal, intradermal, anal, vaginal, topical, and oral routes.

Within certain embodiments, immunotherapy may be active immunotherapy, in which treatment relies on the in vivo stimulation of the endogenous host immune system to react against HSV infection with the administration of immune response-modifying agents (such as polypeptides and polynucleotides as provided herein).

Within other embodiments, immunotherapy may be passive immunotherapy, in which treatment involves the delivery of agents with established HSV-immune reactivity (such as effector cells or antibodies) that can directly or indirectly mediate therapeutic effects and does not necessarily depend on an intact host immune system. Examples of effector cells include T cells as discussed above, T lymphocytes (such as CD8+ cytotoxic T lymphocytes and CD4+ T-helper lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary or intraperitoneal.

Routes and frequency of administration of the therapeutic compositions described herein, as well as dosage, will vary from individual to individual, but may be readily established using standard techniques. In one embodiment, between 1 and about 10 doses may be administered over a 52 week period. In another embodiment, about 6 doses are administered, at intervals of about 1 month, and booster vaccinations are typically be given periodically thereafter. Alternate protocols may be appropriate for individual patients.

A suitable dose is an amount of a compound that, when administered as described above, is capable of promoting an anti-HSV immune response, and is preferably at least 10–50% above the basal (i.e., untreated) level. Such response can be monitored, for example, by measuring the anti-HSV antibodies in a patient. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 μg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a HSV protein may correlate with an improved clinical outcome. Such immune responses may generally be evaluated using standard proliferation, cytotoxicity or cytokine assays, which may be performed using samples obtained from a patient before and after treatment.

HSV Detection and Diagnosis

In general, HSV may be detected in a patient based on the presence of one or more HSV proteins and/or polynucleotides encoding such proteins in a biological sample (for example, blood, sera, sputum urine and/or other appropriate tissue) obtained from the patient. In other words, such proteins may be used as markers to indicate the presence or absence of HSV in a patient. The binding agents provided herein generally permit detection of the level of antigen that binds to the agent in the biological sample. Polynucleotide primers and probes may be used to detect the level of mRNA encoding a HSV protein, which is also indicative of the presence or absence of HSV infection.

There are a variety of assay formats known to those of ordinary skill in the art for using a binding agent to detect polypeptide markers in a sample. See, e.g., Harlow and Lane, *Antibodies: A Laboratory Manual*, Cold Spring Harbor Laboratory, 1988. In general, the presence or absence of HSV in a patient may be determined by contacting a biological sample obtained from a patient with a binding agent and detecting in the sample a level of polypeptide that binds to the binding agent.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length HSV proteins and portions thereof to which the binding agent binds, as described above.

The solid support may be any material known to those of ordinary skill in the art to which the protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 μg, and preferably about 100 ng to about 1 μg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12–A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20® (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with an HSV infection. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20®. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of HSV, the signal detected from the reporter group that remains bound to the solid support is generally compared to a signal that corresponds to a predetermined cut-off value. In one embodiment, the cut-off value for the detection of HSV is the average mean signal obtained when the immobilized antibody is incubated with samples from patients without HSV. In an alternate embodiment, the cut-off value is determined using a Receiver Operator Curve, according to the method of Sackett et al., *Clinical Epidemiology: A Basic Science for Clinical Medicine*, Little Brown and Co., 1985, p. 106–7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of HSV. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 µg, and more preferably from about 50 ng to about 500 ng. Such tests can typically be performed with a very small amount of biological sample.

Of course, numerous other assay protocols exist that are suitable for use with the HSV proteins or binding agents of the present invention. The above descriptions are intended to be exemplary only. For example, it will be apparent to those of ordinary skill in the art that the above protocols may be readily modified to use HSV polypeptides to detect antibodies that bind to such polypeptides in a biological sample. The detection of such protein-specific antibodies can allow for the identification of HSV infection.

HSV infection may also, or alternatively, be detected based on the presence of T cells that specifically react with a HSV protein in a biological sample. Within certain methods, a biological sample comprising $CD4^+$ and/or $CD8^+$ T cells isolated from a patient is incubated with a HSV polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for about 2–9 days (typically about 4 days) at 37° C. with polypeptide (e.g., 5–25 µg/ml). It may be desirable to incubate another aliquot of a T cell sample in the absence of HSV polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of HSV in the patient.

As noted above, HSV infection may also, or alternatively, be detected based on the level of mRNA encoding a HSV protein in a biological sample. For example, at least two oligonucleotide primers may be employed in a polymerase chain reaction (PCR) based assay to amplify a portion of a HSV cDNA derived from a biological sample, wherein at least one of the oligonucleotide primers is specific for (i.e., hybridizes to) a polynucleotide encoding the HSV protein. The amplified cDNA is then separated and detected using techniques well known in the art, such as gel electrophoresis. Similarly, oligonucleotide probes that specifically hybridize to a polynucleotide encoding a HSV protein may be used in a hybridization assay to detect the presence of polynucleotide encoding the HSV protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a HSV protein that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10–40 nucleotides in length. In a preferred embodiment, the oligonucleotide primers comprise at least 10 contiguous nucleotides, more preferably at least 15 contiguous nucleotides, of a DNA molecule having a sequence disclosed herein. Techniques for both PCR based assays and hybridization assays are well known in the art (see, for example, Mullis et al., *Cold Spring Harbor Symp. Quant Biol.*, 51:263, 1987; Erlich ed., *PCR Technology*, Stockton Press, NY, 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not infected with HSV. The amplification reaction may be performed on several dilutions of cDNA, for example spanning two orders of magnitude.

As noted above, to improve sensitivity, multiple HSV protein markers may be assayed within a given sample. It will be apparent that binding agents specific for different HSV polypeptides may be combined within a single assay. Further, multiple primers or probes may be used concurrently. The selection of HSV protein markers may be based on routine experiments to determine combinations that results in optimal sensitivity. In addition, or alternatively, assays for HSV proteins provided herein may be combined with assays for other known HSV antigens.

The present invention further provides kits for use within any of the above diagnostic and/or therapeutic methods. Such kits typically comprise two or more components necessary for performing a diagnostic and/or therapeutic assay and will further comprise instructions for the use of said kit. Components may be compounds, reagents, containers and/or equipment. For example, one container within a diagnostic kit may contain a monoclonal antibody or fragment thereof that specifically binds to a HSV protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a HSV protein in a biological sample. Such kits generally comprise at least one oligonucleotide probe or primer, as described above, that hybridizes to a polynucleotide encoding a HSV protein. Such an oligonucleotide may be used, for example, within a PCR or hybridization assay. Additional components that may be present within such kits include a second oligonucleotide and/or a diagnostic reagent or container to facilitate the detection of a polynucleotide encoding a HSV protein.

EXAMPLES

The following Examples are offered by way of illustration and not by way of limitation.

Example 1

Identification of HSV-2 Antigens

The following examples are presented to illustrate certain embodiments of the present invention and to assist one of ordinary skill in making and using the same. The examples are not intended in any way to otherwise limit the scope of the invention.

Source of HSV-2 positive donors: Lymphocytes were obtained from two types of donors: Group A) seropositive donors with unknown clinical status, and Group B) seropositive donors with well characterized clinical status (viral shedding and ano-genital lesion recurrences).

Group A: Blood samples (50 ml) were obtained from 13 potential donors. No information regarding clinical history of HSV-2 infection was requested. The blood was screened for serum antibody against HSV-1 and HSV-2 by Western blot. PBMCs were also screened for specific proliferative T cell responses to HSV-1 and HSV-2 lysate antigens (ABI; Columbia, Md.). Three donors (AD104, AD116, and AD120) were positive for HSV-2 serum antibody and their PBMCs specifically proliferated in response to HSV-2 antigen. Leukopheresis PBMC were collected from these donors and cryopreserved in liquid nitrogen.

Group B: Ano-genital lesion biopisies were obtained from donors DK21318 and JR5032. Lesion biopsy lymphocytes were expanded in vitro with IL-2 and PHA in the presence of 50 uM acyclovir and subsequently cryopreserved in liquid nitrogen. Typically $5\times10^6$ to $5\times10^7$ lymphocytes are obtained after two weeks. Autologous PBMC were also collected from the blood of DK2318 and JR5032 and cryopreserved in liquid nitrogen.

Generation of CD4+ T cell lines: Cryopreserved PBMCs or lesion-biopsy lymphocytes were thawed and stimulated in vitro with 1 ug/ml HSV-2 antigen (ABI) in RPMI 1640+10% human serum+10 ng/ml IL-7. Irradiated autologous PBMC were added as antigen presenting cells for the lesion biopsy lymphocytes only. Recombinant IL-2 (1 ng/ml) was added on days 1 and 4. The cells were harvested, washed, and replated in fresh medium containing IL-2 and IL-7 on day 7. Recombinant IL-2 was again added on day 10. The T cells were harvested, washed, and restimulated in vitro with HSV-2 antigen plus irradiated autologous PBMC in the same manner on day 14 of culture. The T cell lines were cryopreserved at $1\times10^7$ cells/vial in liquid nitrogen on day 11–12 of the secondary stimulation. After thawing, the cryopreserved T cells retained the ability to specifically proliferate to HSV-2 antigen in vitro. These T cells were subsequently used to screen HSV-2 gene-fragment expression cloning libraries prepared in E. coli, as described below.

Preparation of HSV-2 (333) DNA: HSV-2 strain 333 virus was grown in Vero cells cultured in roller bottles in 200 ml/bottle of Medium 199 (Gibco)+5% FCS. Vero cells are transformed African green monkey fibroblast-like cells that were obtained from ATCC (Cat. # CCL-81). Near-confluence Vero cells (10 roller bottles) were infected with HSV-2 strain 333 virus at an MOI of 0.01 in 50 ml/bottle of Medium 199+1% FCS. Cells and medium were harvested from the roller bottles and the cells pelleted. The supernatant was saved on ice and the cell pellets were resuspended in fresh Medium 199+1% FCS and lysed by 6 cycles of freezing/thawing. The cell debris in the lysates was pelleted and the supernatant pooled with the saved culture supernatant. Virus was pelleted from the pooled supernatants by ultracentrifugation (12,000 g, 2 hours, 4° C.) and resuspended in 2 ml of fresh Medium 199+1% FCS. The virus was further purified on a 5–15% linear Ficoll gradient by ultracentrifugation (19,000 g, 2 hours, 4° C.) as previously described (Chapter 10:Herpes simplex virus vectors of Molecular Virology: A Practical Approach (1993); Authors: F. J. Rixon and J. McClaughlan, Editors: A. J. Davison and R. M. Elliott; Publisher: Oxford University Press, Inc, New York, N.Y.). The HSV-2 virus-containing band was extracted from the gradient, diluted 10-fold with Medium 199, and the virus pelleted by ultracentrifugation at 19,000 g for 4 hours at 4° C. The virus pellet was recovered and resuspended in 10 ml of Tris/EDTA (TE) buffer. Intact virions were treated with DNAse and RNAse to remove cellular DNA and RNA. The enzymes were then inactivated by addition of EDTA and incubation at 65° C. DNA was prepared from the gradient-purified virus by lysis of the viral particles with SDS in the presence of EDTA, followed by phenol/chlorform extraction to purify the genomic viral DNA. HSV-2 DNA was precipitated with EtOH and the DNA pellet was dried and resuspended in 1 ml of Tris/EDTA buffer. The concentration and purity of the DNA was determined by reading the OD 260 and OD 280 on a UV spectrophotometer. Genomic DNA prepared in this manner was used for construction of an HSV-2 genomic fragment expression library in E. coli.

Construction of HSV-2 DNA fragment libraries in the pET17b vector: The HSV2-I library was constructed as follows. DNA fragments were generated by sonicating genomic HSV-2 DNA for 4 seconds at 15% output with a Fisher "60 SonicDismembrator" (Fisher). The sonicated DNA was then precipitated, pelleted, and resuspended in 11 uL TE buffer. The approximate size of the DNA fragments was measured by agarose gel electropheresis of 1 uL of the fragmented HSV-2 genomic DNA vs. 1.5 ug unsonicated material. The average size of the DNA fragments was determined to be approx. 500 bp when visualized after ethidium bromide staining of the gel. Incomplete DNA fragment ends were filled in (blunted) using T4 DNA polymerase. EcoR1 adapters were then ligated to the blunt ends of the DNA fragments using T4 DNA ligase. The DNA was then kinased using T4 Polynucleotide Kinase, purified using a manually loaded column of S-400-HR Sephacryl (Sigma) and ligated into the pET17b expression vector. The HSV2-II library was constructed in a similar fashion. The average size of inserts in this library was determined to be approximately 1000 bp.

Generation of the HSV-2 fragment expression library in E. coli. The HSV2-I library was transformed into E. coli for preparation of glycerol stocks and testing of HSV-2 DNA insert representation. The DNA was transformed into ElectroMAX DH10B E. coli (Gibco) in order to prepare a large quantity of HSV-2/pET17b library DNA. Transformed bacteria were grown up on 3 LB/Ampicillin plates (approx. 750 CFU/plate), a small subset of colonies were picked for sequencing of DNA inserts, and the remaining bacteria from each plate collected as a pool for preparation of plasmid DNA. These pools were named HSV-2 Pools 9, 10 and 11. Glycerol stocks of a portion of these bacterial pools were stored at −80° C. Plasmids were purified from the remainder of the pools. Equal quantities of plasmid DNA from each of the 3 pools was combined to make a single pool of plasmid DNA. The tranformation efficiency of the pooled DNA was empirically determined using JM109(DE3) E. coli bacteria. JM109(DE3) bacteria were then transformed with an amount of the final pool of library DNA that was expected to yield 15 colony-forming units (CFU) per plate. The transformed bacteria were then plated on 100 LB/amp plates. Twenty CFU (on average) were actually observed on each of the 100 plates; therefore the pool size of this HSV-2 library was about 20 clones/pool. The bacterial colonies were collected as a pool from each plate in approximately 800 ul/plate of LB+20% glycerol. Each pool was distributed equally (200 ul/well) among four 96-well U-bottom plates and these "master stock" plates were stored at −80° C. The size of this HSV-2 gene-fragment library (hereafter referred to as HSV2I) was therefore 96 pools of 20 clones/pool. Plasmid DNA was prepared from 20 randomly picked colonies and the inserts sequenced. Approximately 15% (3/20) contained HSV-2 DNA as insert, 80% (16/20) contained non-HSV-2 DNA (*E. coli* or Vero cell DNA), and 5% (1/20) contained no insert DNA. The HSV2-II DNA library was transformed into *E. coli* and random colonies analyzed in a similar manner. Relevant differences in the construction of library HSV2-II included the transformation of the HSV-2/pET17b ligation product into NovaBlue (Novagen) chemically competent *E. coli* instead of using electroporation for preparation of a larger quantity of plasmid for pooling and transformation into JM109(DE3) bacteria for empirical evaluation. Additionally, plasmid DNA was prepared from 10 pools averaging 160 colonies/plate. These 10 plasmid pools were combined in an equivalent fashion (normalized based on spectrophotometer readings) into one pool for transformation into JM109(DE3) as per previously, yielding an average of 20 colonies(clones)/plate for harvesting into glycerol stock pools as before. Approximately 25% contained HSV-2 DNA as insert, with the remaining 75% containing *E. coli* DNA as insert.

Induction of the HSV-2 fragment expression library for screening with human CD4+ T cells. One of the master HSV2I library 96-well plates was thawed at room temperature. An aliquot (20 uL) was transferred from each well to a new 96 well plate containing 180 uL/well of LB medium+ampicillin. The bacteria were grown up overnight and then 40 ul transferred into two new 96-well plates containing 160 uL 2×YT medium+ampicillin. The bacteria were grown for 1 hr. 15 min at 37° C. Protein expression was then induced by addition of IPTG to 200 mM. The bacteria were cultured for an additional 3 hrs. One of these plates was used to obtain spectrophotometer readings to normalize bacterial numbers/well. The second, normalized plate was used for screening with CD4+ T cells after pelleting the bacteria (approx. 2×10$^7$/well) and removing the supernatants. The HSV2-II library was grown and induced in a similar fashion.

Preparation of autologous dendritic APC's: Dendritic cells (DCs) were generated by culture of plastic-adherent donor cells (derived from 1×10$^8$ PBMC) in 6 well plates (Costar 3506) in RPMI 1640+10% of a 1:1 mix of FCS:HS+ 10 ng/ml GM-CSF+10 ng/ml IL-4 at 37° C. Non-adherent DCs were collected from plates on day 6 of culture and irradiated with 3300 Rads. The DCs were then plated at 1×10$^4$/well in flat-bottom 96-well plates (Costar 3596) and cultured overnight at 37° C. The following day, the DCs were pulsed with the induced HSV2-I or HSV2-II library pools by resuspending the bacterial pellets in 200 ul RPMI 1640+10%FCS without antibiotics and transferring 10 ul/well to the wells containing the DCs in 190 ul of the same medium without antibiotics. The DCs and bacteria were co-cultured for 90 minutes at 37° C. The DCs were then washed and resuspended in 100 ul/well RPMI 1640+10% HS+L-glut.+50 ug/ml gentamicin antibiotic.

Preparation of responder T cells: Cryopreserved CD4+ T cell lines were thawed 5 days before use and cultured at 37° C. in RPMI 1640+10% HS+1 ng/ml IL-2+10 ng/ml IL-7. After 2 days, the medium was replaced with fresh medium without IL-2 and IL-7.

Primary screening of the HSV-2 libraries: The T cells were resuspended in fresh RPMI 1640+10% HS and added at 2×10$^4$/well to the plates containing the *E. coli*-pulsed autologous DC's. After 3 days, 100 ul/well of supernatant was removed and transferred to new 96 well plates. Half of the supernatant was subsequently tested for IFN-gamma content by ELISA and the remainder was stored at −20° C. The T cells were then pulsed with 1 uCi/well of [3H]-Thymidine (Amersham/Pharmacia; Piscataway, N.J.) for about 8 hours at 37° C. The 3H-pulsed cells were then harvested onto UniFilter GF/C plates (Packard; Downers Grove, Ill.) and the CPM of [3H]-incorporated subsequently measured using a scintillation counter (Top-Count; Packard). ELISA assays were performed on cell supernatants following a standard cytokine-capture ELISA protocol for human IFN-g.

From the HSV2-I library screening with T cells from D104, wells HSV2I_H10 and HSV2I_H12, for which both CPM and IFN-g levels were significantly above background, were scored as positive.

Breakdown of positive HSV2I library pools: The positive wells (HSV2I_H10 and HSV2I_H12) from the initial CD4+ T cell screening experiment were grown up again from the master glycerol stock plate. Forty-eight sub-clones from each pool were randomly picked, grown up and IPTG-induced as described previously. The subclones were screened against the AD104 CD4+ T cell line as described above. A clone (HSV2I_H12A12) from the HSV2I_H12 pool breakdown scored positive. This positive result was verified in a second AD104 CD4+ T cell assay.

Identification of UL39 as a CD4+ T cell antigen: The positive clone (HSV2I_H12A12) was subcloned and 10 clones picked for restriction digest analysis with EcoRI NB#675 pg. 34. All 10 clones contained DNA insert of the same size (approximately 900 bp in length). Three of these clones (HSV2I_H12A12_1, 7, and 8) were chosen for sequencing and all contained identical insert sequences at both the 5' and 3' ends of the inserts. The DNA sequence of the insert is set forth in SEQ ID NO:1, and contains an open reading frame set forth in SEQ ID NO:2. The insert sequence was compared to the complete genomic sequence of HSV-2 strain HG52 (NCBI site, Accession #Z86099) and the sequence was determined have a high degree of homology to UL39 (a.k.a. ICP6), the large subunit (140 kD) of the HSV ribonucleotide reductase, the sequence of which is set forth in SEQ ID NO:3. The insert sequence set forth in SEQ ID NO: 1 spans nucleotides 876–1690 of the UL39 open reading frame (3,432 bp) and encodes the amino acid sequence set forth in SEQ ID NO:2, which has a high degree of homology to amino acids 292–563 of UL39 (full length= 1143 aa).

Identification of US8A, US3/US4, UL15, UL18, UL27 and UL46 as CD4+ T cell antigens: In a manner essentially identical to that described above for the identification of UL39 as a T cell antigen, an additional HSV-2 gene fragment expression cloning library, referred to as HSV2-II, was prepared, expressed in *E. coli*, and screened with donor T cells.

Screening the HSV2-II library with T cells from donor AD116 identified the clone HSV2II_US8AfragD6.B_B11_T7Trc.seq, determined to have an insert sequence set forth in SEQ ID NO:4, encoding open reading frames having amino acid sequences set forth in SEQ ID NO:5 and 6, with the sequence of SEQ ID NO:5 having a high degree of homology with the HSV-2 US8A protein, the sequence of which is set forth in SEQ ID NO:7.

In addition, screening the HSV2-II library with T cells from donor AD104 identified the following clone inserts:

SEQ ID NO:8, corresponding to clone HSV2II_US3/US4 fragF10B3_T7Trc.seq, containing a potential open reading frame having an amino acid sequence set forth in SEQ ID NO: 10;

SEQ ID NO:9, corresponding to clone HSV2II_US3/US4 fragF10B3_T7P.seq, containing an open reading frame having an amino acid sequence set forth in SEQ ID NO: 11, sharing a high degree of homology with the HSV-2 US3 protein (SEQ ID NO: 12);

SEQ ID NO:13, corresponding to clone HSV2II_UL46fragF11F5_T7Trc.seq, containing an open reading frame having an amino acid sequence set forth in SEQ ID NO: 14, sharing a high degree of homology with the HSV-2 UL46 protein (SEQ ID NO: 15);

SEQ ID NO:16, corresponding to clone HSV2II_UL27frag-H2C7_T7Trc.seq, containing an open reading frame having an amino acid sequence set forth in SEQ ID NO:17, sharing a high degree of homology with the HSV-2 UL27 protein (SEQ ID NO:18);

SEQ ID NO:19, corresponding to clone HSV2II_UL18fragF10A1_rc.seq, containing open reading frames having amino acid sequences set forth in SEQ ID NO:20, 21 and 22, with SEQ ID NO:22 sharing a high degree of homology with the HSV-2 UL18 protein (SEQ ID NO: 23); and SEQ ID NO:24, corresponding to clone HSV2II_UL15fragF10A12_rc.seq, containing an open reading frame having an amino acid sequence set forth in SEQ ID NO: 25, sharing a high degree of homology with the HSV-2 UL15 protein (SEQ ID NO: 26).

Example 2

Identification of HSV-2 Antigens

CD4+ T cells from AD104 were found to recognize inserts from clones HSV2II_UL46fragF11F5_T7Trc.seq (SEQ ID NO: 13) and HSV2II_UL18frgaF10A1_rc.seq (SEQ ID NO: 19) as described in detail in Example 1. The sequences from these clones share a high degree of homology to the HSV2-I genes, UL46 (SEQ ID NO: 15) and UL18 (SEQ ID NO:23), respectively. Therefore to further characterize the epitopes recognized by these T cells, overlapping 15-mer peptides were made across the clone insert fragments of UL18 and UL46. Peptide recognition by AD104's CD4+ T cells was tested in a 48 hour IFN-g ELISPOT assay. ELISPOTS were performed by adding 1×10⁴ autologous EBV-transformed B cells (LCL) or DCs per well in 96 well ELISPOT plates. 2×10⁴ AD104 CD4+ T cells from AD104's line were added per well with 5 μg/ml of the HSV-2 peptides. AD104 CD4+ T cells recognized peptides 20 and 21 (SEQ ID NO: 32 and 33) of UL18, and peptides 1, 4, 9, 10, and 20 of UL46 (SEQ ID NO: 27–31).

Example 3

Identification of HSV-2 Antigens

CD4+ T cell lines were generated from DK2318 and JR5032 lesion-biopsy. The CD4+ lymphocytes were stimulated twice in vitro on irradiated autologous PBMC and HSV-2 antigen as described in example 1. The lines were tested for their antigen specificity as described in example 1 and cryopreserved. The CD4+ T cell lines were screened against the HSV2-II expression-cloning library generated in Example 1.

DK2318 was shown to react with clones C12 and G10. Clone C12 was determined to have an insert sequence set forth in SEQ ID NO:36. This insert was found to have sequence homology with fragments of 2 HSV-II genes, nucleotides 723–1311 of UL23 and nucleotides 1–852 of UL22. These sequences correspond to amino acids 241–376 of UL23 as set forth in SEQ ID NO:40 and amino acids 1–284 as set forth in SEQ ID NO:41. The DNA sequence of SEQ ID NO:36 was searched against public databases including Genbank and shown to have a high degree of sequence homology to the HSV-2 genes UL23 and UL22 set forth in SEQ ID NO:37 and 38 respectively. The protein sequences encoded by SEQ ID NO:37 and 38 are set forth in SEQ ID NO:39 and 45. Clone G10 was determined to have an insert sequence which is set forth in SEQ ID NO:48, encoding open reading frames having an amino acid sequence set forth in SEQ ID NO:50, with the sequence of SEQ ID NO:48 having a high degree of sequence homology with HSV-2 UL37, the sequence of which is set forth in SEQ ID NO:49, encoding open reading frames having the amino acid sequences set forth in SEQ ID NO:51. DK2318's CD4+ T cell line was screened against overlapping 15 mers covering the UL23 protein. DK2318's CD4 line was shown to react against three UL23 specific peptides (SEQ ID NO:41–43) suggesting that UL23 is a target.

The CD4+ T cell line generated from JR5032 was found to react with clone E9 which contained an insert sequence set forth in SEQ ID NO: 34, encoding open reading frames having amino acid sequences set forth in SEQ ID NO: 46, with SEQ ID NO: 34 having a high degree of sequence homology with HSV-2 RL2 (also referred to as ICP0), the sequence of which is set forth in SEQ ID NO:35, encoding an open reading frame having the amino acid sequences set forth in SEQ ID NO:47.

Example 4

Characterization of CD4 Clones F11F5 and G10A9

Examples 2 and 3 describe the generation of CD4 T cell lines from donors AD104 and DK2313 which were screened against cDNA libraries generated using the HSV-2 333 strain. AD104 was found to react against the clone HSV2II_UL46fragF11F5. This insert was partially sequenced with the sequence being disclosed in SEQ ID NO:13. Full length sequencing of the insert revealed that it encoded a fragment of UL46 which was derived from the HSV-2 333 strain. The DNA and amino acid sequences from this insert are disclosed in SEQ ID NO:52 and 54, respectively.

DK2312 was found to react against the clone G10. This insert was partially sequenced and the sequence was disclosed in SEQ ID NO:48. Full length sequencing revealed that it encoded a fragment of UL37 which was derived from the HSV-2 333 strain. The DNA and amino acid sequences from this insert are disclosed in SEQ ID NO:53 and 55, respectively.

Example 5

Identification of CD8-Specific Immunoreactive Peptides Derived from HSV-2

Peripheral blood mononuclear cells were obtained from the normal donors AD104, AD116, AD120, and D477. These donors were HLA typed using low-resolution DNA-typing methodology and the results are presented in Table 2.

TABLE 2

| DONOR | AD104    | AD116      | AD120      | D477       |
|-------|----------|------------|------------|------------|
| HLA-A | 24, 33   | 0206, 24   | 0211, 3303 | 0201, 2501 |
| HLA-B | 45, 58   | 0702, 35   | 1505, 4403 | 1501, 5101 |
| HLA-C | 01, 0302 | 0702, 1203 | 0303, 0706 | 0304, 12   |

In order to determine which epitopes of HSV-2 were immunoreactive, synthetic peptides were synthesized. These peptides were 15 amino acids in length overlapping by 11 amino acids. The peptides were synthesized across the following regions of the following HSV-2 genes: UL15 (aa 600–734), UL18 (aa 1–110), UL23 (aa 241–376), UL46 (aa 617–722), US3 (aa 125–276), and US8A (aa 83–146).

CD8⁺ T cells were purified from the PBMC of each of the donors described above using negative selection. The purified CD8+ T cells were then tested for their reactivity against the HSV-2 specific peptides. Co-cultures containing $2 \times 10^5$ CD8⁺ T cells, $1 \times 10^4$ autologous dendritic cells and 10 μg/ml of a peptide pool (on average containing 10 peptides/pool) were established in 96 well ELISPOT plates that had been pre-coated with anti-human IFN-γ antibody (1D1K: mAbTech). After 24 hours, the ELISPOT plates were developed using a standard protocol well known to one of skill in the art. The number of spots per well were then counted using an automated video microscopy ELISPOT plate reader. CD8+ T cells from donors demonstrating a positive response against a peptide pool were then subsequently tested against the individual peptides in that pool in a second ELISPOT assay. The results of peptide reactivity are presented in Table 3.

TABLE 3

| Donor | HSV-2 Gene | Peptide # (amino acid numbering) | SEQ ID NO |
| --- | --- | --- | --- |
| AD104 | US3 | #33 (262–276) | 63 |
| AD116 | UL15 | #23 (688–702) | 56 |
|  |  | #30 (716–730) | 57 |
|  | UL23 | #7 (265–279) | 58 |
|  | UL46 | #2 (621–635) | 59 |
|  |  | #8 (645–659) | 60 |
|  |  | #9 (649–663) | 61 |
|  |  | #11 (657–671) | 62 |
|  | US8A | #5 (99–113) | 64 |
| AD120 | UL46 | Peptides: #1–12 | — |
| D477 | UL18 | Peptides: #1–12 | — |
|  | UL23 | Peptides: #1–20 | — |
|  | UL46 | Peptides: #1–12 | — |

Example 6

Identification of HSV-2 Antigens Using CD4+ T Cell Cloning

This Example describes the generation of CD4⁺ T cell clones from two donors. Donor JH is an HSV-2 seropositive donor who experiences infrequent recurrences of genital lesions and sheds virus infrequently, as determined by virus culture and PCR on daily swabs). HH is an HSV-2 exposed, but HSV-2 seronegative donor.

CD4⁺ T cell clones for JH were generated by stimulating the donor's peripheral blood mononuclear cells (PBMC) for 14 days with UV-inactivated HSV-2, strain 333. Following two weeks of stimulation, the cells were cloned into 96 well plates using limiting dilution, and stimulated non-selectively using a monoclonal antibody against CD3. Following 2 weeks of expansion, the clones were tested for their reactivity against UV-inactivated HSV-2, gB2 protein, gD2 protein and UL50. Clones 5 and 34 recognized gB2, clone 30 recognized gD2, and clone 11 recognized UL50.

Clones 39 and 47 were used for expression cloning. Antigen presenting cells (APC) used for both the expansion of the T cells and for the expression cloning were derived from HLA-matched normal donors. The clones were screened against two HSV-2 specific libraries, HSV2-II and HSV2-II.

Clone 39 was found to specifically recognize a partial sequence from UL39 presented by the HSV2-III library pools 1F4, 1G2, 2C4, and 3G11. The full length DNA sequence of UL39 is disclosed in SEQ ID NO:65, with the corresponding protein sequence disclosed in SEQ ID NO:3. The specific DNA sequence from pools 1F4, 1G2, and 3G11 that Clone 39 reacted against were identical. The inserts were found to be 875 bp in length and the DNA sequence is disclosed in SEQ ID NO:66, with the corresponding amino acid sequence disclosed in SEQ ID NO:74. The insert from pool 2C4 was found to be 800 bp in length, the DNA sequence of which is disclosed in SEQ ID NO:67, with the corresponding amino acid sequence disclosed in SEQ ID NO:75.

Clone 47 was found to specifically recognize a partial sequence from ICP0 (RL2) presented by the HSV-2III library pools 2B2, 3A1, 3F12, 3H6, and 4B2. The full length DNA sequence of ICP0 was disclosed in SEQ ID NO:35, with the corresponding protein sequence disclosed in SEQ ID NO:47. The sequence inserts from pools 3H6, 3F12, and 4B2 were found to be identical, with an insert size of 1100 bp. The DNA sequence corresponding to the 5' end of this sequence is disclosed in SEQ ID NO:68, with the 3' end disclosed in SEQ ID NO:69. The insert from pool 3A1 was found to be 1000 bp in length, with the 5' portion of the DNA sequence disclosed in SEQ ID NO:70 and the 3' end of the insert disclosed in SEQ ID NO:71. The insert from pool 2B2 was found to be 1300 bp in length. The DNA sequence corresponding to the 5' end of the insert is disclosed in SEQ ID NO:72, with the 3' end of the sequence disclosed in SEQ ID NO:73.

CD4⁺ T cell clones for HH were generated by stimulating the donor's peripheral blood mononuclear cells (PBMC) for 14 days with UV-inactivated HSV-2, strain 333. Following two weeks of stimulation, the cells were cloned into 96 well plates using limiting dilution, and stimulated non-selectively using PHA. The clones were screened for their ability to proliferate in response to both HSV-1 and HSV-2 proteins. Clones 6, 18, 20, 22, 24, 27, 28, 29, 41, and 45 were all found to react strongly against HSV-1, however only clones 6, 18, 20, 22, and 24 were found to respond strongly to HSV-2. Therefore, clones 6, 18, 20, 22, and 24 were selected for expression cloning use. APC from an HLA-matched donor were used for in vitro expansion of the clones and for expression cloning. The clones were screened against two HSV-2 specific libraries, HSV2-II and HSV2-III (see Example 1 for details of libraries).

Clone 22 was found to recognize UL46 presented by the HSV2-II library, pools F7 and F11, in addition to pool 4E8 that was derived from the HSV2-III library.

Example 7

Generation of a UL19 Expressing Vaccinia Virus

The UL19 gene was cloned into the Western Reserve Strain of Vaccinia Virus. This viral vector allows expression of UL19 in any cell infected with the vaccinia virus, or additionally, the vaccinia virus can be used to immunize humans or animals to generate immune responses against UL19.

In order to generate the vaccinia virus expressing UL19, the UL19 open reading frame (ORF), the sequence of which is disclosed in SEQ ID NO:76, was cloned from HSV-2 and inserted into the vaccinia virus shuttle plasmid, pSC11 (the DNA sequence of which is disclosed in SEQ ID NO:77). CV-1 cells transfected with the shuttle vector, pSC11/UL19, were co-infected with the wild-type Western Reserve Vaccinia Virus. In some cells, the shuttle plasmid underwent homologous recombination with the vaccinia virus, inserting the UL19 gene into the thymidine kinase location. These recombinant virions were isolated by plaque purification of 5-Bromo-deoxyuridine (BrdU) resistant virus that expressed Beta-galactosidase. The purified virus can then be used to infect cells to express the UL19 protein.

Example 8

Generation of a UL47 Expressing Vaccinia Virus

The UL47 gene was cloned into the Western Reserve Strain of Vaccinia Virus. This viral vector allows expression of UL47 in any cell infected with the vaccinia virus, or additionally, the vaccinia virus can be used to immunize humans or animals to generate immune responses against UL47.

In order to generate the vaccinia virus expressing UL47, the UL47 ORF, the sequence of which is disclosed in SEQ ID NO:78, was cloned from HSV-2 and inserted into the vaccinia virus shuttle plasmid, pSC11 (the DNA sequence of which is disclosed in SEQ ID NO:77). CV-1 cells transfected with the shuttle vector, pSC11/UL47, were co-infected with the wild-type Western Reserve Vaccinia Virus. In some cells, the shuttle plasmid underwent homologous recombination with the vaccinia virus, inserting the UL47 gene into the thymidine kinase location. These recombinant virions were isolated by plaque purification of 5-Bromo-deoxyuridine (BrdU) resistant virus that expressed Beta-galactosidase. The purified virus can then be used to infect cells to express the UL47 protein.

Example 9

Generation of a UL50 Expressing Vaccinia Virus

The UL50 gene was cloned into the Western Reserve Strain of Vaccinia Virus. This viral vector allows expression of UL50 in any cell infected with the vaccinia virus, or additionally, the vaccinia virus can be used to immunize humans or animals to generate immune responses against UL50.

In order to generate the vaccinia virus expressing UL50, the UL50 ORF, the sequence of which is disclosed in SEQ ID NO:79, was cloned from HSV-2 and inserted into the vaccinia virus shuttle plasmid, pSC11 (the DNA sequence of which is disclosed in SEQ ID NO:77). CV-1 cells transfected with the shuttle vector, pSC11/UL50, were co-infected with the wild-type Western Reserve Vaccinia Virus. In some cells, the shuttle plasmid underwent homologous recombination with the vaccinia virus, inserting the UL50 gene into the thymidine kinase location. These recombinant virions were isolated by plaque purification of 5-Bromo-deoxyuridine (BrdU) resistant virus that expressed Beta-galactosidase. The purified virus can then be used to infect cells to express the UL50 protein.

Example 10

Generation of a UL49 Expressing Vaccinia Virus

To facilitate intracellular degradation and Class I presentation of the Herpes Simplex Virus gene, UL49 (the DNA sequence of which is disclosed in SEQ ID NO:81), a fusion of the human Ubiquitin gene (the DNA sequence of which is disclosed in SEQ ID NO:80) and UL49 was constructed with the Ubiquitin gene located 5' of the UL49 gene. The last amino acid of the Ubiquitin ORF was mutated from glycine to alanine to prevent co-translational cleavage of the fusion protein. After assembly of the fusion by PCR, it was cloned into the vaccinia virus shuttle vector, pSC11 (the DNA sequence of which is disclosed in SEQ ID NO:77). CV-1 cells transfected with the shuttle vector, pSC11/ubiquitin-UL49, were co-infected with the wild type Western Reserve Vaccinia Virus. In some cells the shuttle plasmid underwent homologous recombination with the virus inserting the ubiquitin-UL49 gene into the thymidine kinase location. These recombinant virions were isolated by plaque purification of 5-Bromo-deoxyuridine (BrdU) resistant virus that expresses Beta-galactosidase. The purified virus can then be used to infect cells to express the UL49 protein.

The cells engineered to express UL49 are used to assay for specific immune responses to UL49 protein. This vaccinia virus vector can also be used as a vaccine in humans to generate preventative or therapeutic responses against HSV-2.

Example 11

Expression of Herpes Simplex Virus Antigens in E. Coli

This example describes the expression of recombinant HSV antigens using an E. coli expression system combined with an N-terminal histadine tag.

Expression of HSV UL21 in E. coli:

The HSV UL21 coding region (the DNA sequence of which is disclosed in SEQ ID NO:85) was PCR amplified with the following primers:

```
                                      (SEQ ID NO:98)
PDM-602 5'gagctcagctatgccaccacc3'

(SEQ ID NO:99)
PDM-603 5'cggcgaattcattagtagaggcggtggaaaaag3'
```

The PCR was Performed with the Following Reaction Components:
  10 µl 10×Pfu buffer
  1 µl 10 mM dNTPs
  2 µl 10 µM of each primer
  83 µl of sterile water
  1.5 µl Pfu DNA polymerase (Stratagene, La Jolla, Calif.)
  50 ng DNA PCR Amplification was Performed Using the Following Reaction Conditions:
  96° C. for 2 minutes, followed by 40 cycles of:
  96° C. for 20 seconds;
  60° C. for 15 seconds; and
  72° C. for 2 minutes, followed by a final extension step of:
  72° C. for 4 minutes.

The PCR product was digested with EcoRI and cloned into pPDM His that had been cut with Eco72I and EcoRI. The amino acid sequence for the UL21-His construct was confirmed, and is disclosed in SEQ ID NO:91. The construct was then transformed into BLR pLys and BLR Codon Plus RP cells.

Expression of HSV UL39 in E. coli:

The HSV UL39 coding region (the DNA sequence of which is disclosed in SEQ ID NO:89) was PCR amplified from clone pET17b with the following primers:

```
                                      (SEQ ID NO:100)
PDM-466 5'cacgccgccgcaccccaggcggac3'

(SEQ ID NO:101)
PDM-467 5'cggcgaattcattagtagaggcggtggaaaaag3'
```

The PCR was Performed with the Following Reaction Components:
  10 µl 10×Pfu buffer 1 μl 10 mM dNTPs
2 μl 10 μM of each primer
83 μl of sterile water
1.5 μl Pfu DNA polymerase (Stratagene, La Jolla, Calif.)
50 ng DNA PCR Amplification was Performed Using the Following Reaction Conditions:
96° C. for 2 minutes, followed by 40 cycles of:
96° C. for 20 seconds;
66° C. for 15 seconds; and
72° C. for 2 minutes, followed by a final extension step of:
72° C. for 4 minutes.

The PCR product was digested with EcoRI and cloned into pPDM His that had been cut with Eco72I and EcoRI. The amino acid sequence for the UL39-His construct was confirmed, and is disclosed in SEQ ID NO:90. The construct was then transformed into BLR pLys and BLR Codon Plus RP cells.

Expression of HSV UL49 in *E. coli*:

The HSV UL49 coding region (the DNA sequence of which is disclosed in SEQ ID NO:83) was PCR amplified from clone pET17b with the following primers:

(SEQ ID NO:102)
PDM-466:   5'cacacctctcgccgctccgtcaagtc3'

(SEQ ID NO:103)
PDM-467:   5'cataagaattcactactcgaggggcggcggggacg3'

The PCR was Performed with the Following Reaction Components:
10 μl 10×Pfu buffer
10 μl 10×PCRx enhancer solution
3 μl 10 mM dNTPs
3 μl 50 mM mgSO$_4$
2 μl 10 μM of each primer
68 μl of sterile water
1.0 μl Pfx polymerase (Gibco)
50 ng DNA PCR Amplification was Performed Using the Following Reaction Conditions:
96° C. for 2 minutes, followed by 40 cycles of:
96° C. for 20 seconds;
67° C. for 15 seconds; and
72° C. for 2 minutes, followed by a final extension step of:
72° C. for 4 minutes.

The PCR product was digested with EcoRI and cloned into pPDM His that had been cut with Eco72I and EcoRI. The amino acid sequence for the UL49-His construct was confirmed, and is disclosed in SEQ ID NO:97. The construct was then transformed into BLR pLys and BLR Codon Plus RP cells.

Expression of HSV UL50 in *E. coli*:

The HSV UL50 coding region (the DNA sequence of which is disclosed in SEQ ID NO:82) was PCR amplified from clone pET17b with the following primers:

(SEQ ID NO:104)
PDM-458:   5'cacagtcagtggggcccagggcgatcc3'

(SEQ ID NO:105)
PDM-459:   5'cctagaattcactagatgccagtggagccaaaccc3'

The PCR was Performed with the Following Reaction Components:
10 μl 10×Pfu buffer
1 μl 10 mM dNTPs
2 μl 10 μM of each primer
83 μl of sterile water
1.5 μl Pfu DNA polymerase (Stratagene, La Jolla, Calif.)
50 ng DNA PCR Amplification was Performed Using the Following Reaction Conditions:
96° C. for 2 minutes, followed by 40 cycles of:
96° C. for 20 seconds;
68° C. for 15 seconds; and
72° C. for 2 minutes and 30 seconds, followed by a final extension step of:
72° C. for 4 minutes.

The PCR product was digested with EcoRI and cloned into pPDM His that had been cut with Eco72I and EcoRI. The amino acid sequence for the UL50-His construct was confirmed, and is disclosed in SEQ ID NO:96. The construct was then transformed into BLR pLys and BLR Codon Plus RP cells.

Expression of HSV UL19 in *E. coli*:

The HSV UL19 coding region (the DNA sequence of which is disclosed in SEQ ID NO:84) was PCR amplified from clone pET17b with the following primers:

(SEQ ID NO:106)
PDM-453:   5'gccgctcctgcccgcgaccccccc3'

(SEQ ID NO:107)
PDM-457:   5'ccagaattcattacagagacaggcccttagc3'

The PCR was Performed with the Following Reaction Components:
10 μl 10×Pfu buffer
1 μl 10 mM dNTPs
2 μl 10 μM of each primer
83 μl of sterile water
1.5 μl Pfu DNA polymerase (Stratagene, La Jolla, Calif.)
50 ng DNA PCR Amplification was Performed Using the Following Reaction Conditions:
96° C. for 2 minutes, followed by 40 cycles of:
96° C. for 20 seconds;
70° C. for 15 seconds; and
72° C. for 4 minutes, followed by a final extension step of:
72° C. for 4 minutes.

The PCR product was digested with EcoRI and cloned into pPDM His that had been cut with Eco72I and EcoRI. The amino acid sequence for the UL19-His construct was confirmed, and is disclosed in SEQ ID NO:95. The construct was then transformed into BLR pLys and BLR Codon Plus RP cells.

Expression of HSV UL47 in *E. coli*:

The HSV UL47 coding region (the DNA sequence of which is disclosed in SEQ ID NO:87) was PCR amplified using the following primers:

(SEQ ID NO:108)
PDM-631:   5'cactccgtggcgcgggcatgccg3'

(SEQ ID NO:109)
PDM-632:   5'ccgttagaattcactatgggcgtggcgggcc3'

The PCR was Performed with the Following Reaction Components:
10 μl 10×Pfu buffer
1 μl 10 mM dNTPs
2 μl 10 μM of each primer
83 μl of sterile water
1.5 μl Pfu DNA polymerase (Stratagene, La Jolla, Calif.)
50 ng DNA PCR Amplification was Performed Using the Following Reaction Conditions:

96° C. for 2 minutes, followed by 40 cycles of:

96° C. for 20 seconds;

67° C. for 15 seconds; and

72° C. for 2 minutes and 30 seconds, followed by a final extension step of:

72° C. for 4 minutes.

The PCR product was digested with EcoRI and cloned into pPDM His that had been cut with Eco72I and EcoRI. The amino acid sequence for the UL47-His construct was confirmed, and is disclosed in SEQ ID NO:94. The construct was then transformed into BLR pLys and BLR Codon Plus RP cells. Protein yields were low using this construct. UL47 was also cloned into pPDM Trx with two histadine tags that had been digested with StuI and EcoRI. The DNA and amino acid sequences for this construct are disclosed in SEQ ID NOs:86 and 92, respectively. Protein yields were much higher using this fusion construct.

Four additional fragments of UL47, designated UL47 A–D were also PCR amplified.

The UL47 A Coding Region was Amplified Using the Following Primer Pairs:

```
                                              (SEQ ID NO:110)
PDM-631: 5'cactccgtgcgcgggcatgccg3'

(SEQ ID NO:111)
PDM-645: 5'catagaattcatcacgcgcgggaggggctggtttttgc3'
```

The UL47 B Coding Region was Amplified Using the Following Primer Pairs:

```
                                              (SEQ ID NO:112)
PDM-646:   5'gacacggtggtcgcgtgcgtggc3'

(SEQ ID NO:113)
PDM-632:   5'ccgttagaattcactatgggcgtggcgggcc3'.
```

Both Fragments were Amplified Using the Following PCR Reaction Components:

10 µl 10×Pfu buffer

1 µl 10 mM dNTPs

2 µl 10 µM of each primer

83 µl of sterile water 1.5 µl Pfu DNA polymerase (Stratagene, La Jolla, Calif.)

50 ng DNA

PCR Amplification was Performed Using the Reaction Conditions:

96° C. for 2 minutes, followed by 40 cycles of:

96° C. for 20 seconds;

67° C. for 15 seconds; and

72° C. for 2 minutes, followed by a final extension step of:

72° C. for 4 minutes.

The UL47 C Coding Region was Amplified Using the Following Primer Pairs:

```
                                              (SEQ ID NO:114)
PDM-631:    5'cactccgtgcgcgggcatgccg3'

(SEQ ID NO:115)
PDM-739:    5'cgtatgaattcatcagacccacccgttg3'
```

The UL47 D Coding Region was Amplified Using the Following Primer Pairs:

```
                                              (SEQ ID NO:116)
PDM-740: 5'gtgctggcgacggggctcatcc3'

(SEQ ID NO:117)
PDM-632: 5'ccgttagaattcactatgggcgtggcgggcc 3'.
```

Both Fragments were Amplified Using the Following PCR Reaction Components:

10 µl 10×Pfu buffer

1 µl 10 mM dNTPs

2 µl 10 µM of each primer

83 µl of sterile water 1.5 µl Pfu DNA polymerase (Stratagene, LaJolla, Calif.)

50 ng DNA

PCR Amplification was Performed Using the Following Reaction Conditions:

96° C. for 2 minutes, followed by 40 cycles of:

96° C. for 20 seconds;

63° C. for 15 seconds; and

72° C. for 2 minutes, followed by a final extension step of:

72° C. for 4 minutes.

The PCR product from UL47 C was digested with EcoRI and cloned into pPDM His that had been digested with Eco72I and EcoRI. The sequence was confirmed then the construct was transformed into BLR pLys S and BLR CodonPlus RP cells. The DNA and amino acid sequences of UL47 C are disclosed in SEQ ID NOs:88 and 93, respectively.

Example 12

Identification of a Novel DNA Sequence Encoding The HSV-2 Gene, US8

The US8 gene of HSV-2 was cloned from the laboratory HG52 viral strain and sequenced, the DNA and amino acid sequences of which are disclosed in SEQ ID NOs:118 and 120, respectively. SEQ ID NO:118 was then compared to the HSV-2 HG52 strain genomic sequence contained in GenBank (accession number Z86099), the DNA and amino acid sequences of which are disclosed in SEQ ID NOs:119 and 121, respectively. This comparison revealed that SEQ ID NO:118 contained an extra base pair at position 542 that results in a frameshift. The presence of the extra base pair was also confirmed in a second laboratory strain of HSV-2, 333. There was one additional base pair (bp 156) upstream of the first stop codon in SEQ ID NO:118 that differed from the GenBank USB sequence (SEQ ID NO:119). No change in the US8 amino acid sequence would result from the change in the nucleotide sequence at base pair 156.

In addition to examining the sequence of a number of laboratory strains of HSV-2, genomic DNA sequence was also obtained from two clinically isolated viral samples, donors RW1874 and HV5101). Using PCR primers designed to gene specific sequences both up- and downstream of the position 542 insertion, this region was PCR amplified and directly sequenced from the purified amplicon using the same primer pair. The sequences obtained from both RW1874 and HV5101 showed the additional guanine nucleotide at position 542. HV5101 had one additional base pair change at base pair 571 (G/571/C:HV5101/location/HG52) when compared to HG52 (SEQ ID NO:119). This difference is a non-conservative change in the frameshift form.

Example 13

Vaccination with the HSV-2 UL47 Protein Elicits Both a $CD4^+$ and $CD8^+$ Specific T Cell Response This example demonstrates the effectiveness of UL47 as a vaccine against HSV-2. Balb/c mice vaccinated with UL47, delivered by plasmid DNA, mounted a UL47-specific CD4+ and CD8+ cell response.

Two Balb/c mice were immunized three times with 100 μg of UL47 plasmid DNA (UL47 DNA), an additional four mice were immunized twice with UL47, followed by infection with $1 \times 10^3$ pfu of an attenuated HSV-2 strain, 333vhsB (UL47 DNA/HSV). A further four mice received HSV-2 infection alone (HSV control). The spleens were harvested two weeks post-final immunization and stimulated in vitro with vaccinia-UL47 for 7 days.

On day 7, the splenocytes were assayed for cytotoxic activity by chromium release against P815 cells pulsed with pools of 10–15-mer peptides that spanned the UL47 gene (18 pools total). The splenocytes were re-stimulated in vitro and then re-assayed against positive peptide pools, plus the constitutive 15-mer peptides. At an effector:target ratio of 100:1, specific lytic activity by CD8+ cells could be seen in response to P815 cells pulsed with peptides 85 (SEQ ID NO:122), 89 (SEQ ID NO:123), 99 and 98 (SEQ ID NO:124), 105 (SEQ ID NO:125), and 112 (SEQ ID NO:126).

In order to determine the presence of a CD4+ T cell responses, splenocytes were stimulated in vitro with 5 μg/ml recombinant UL47 (rUL47). Three days following stimulation, the culture supernatants were harvested and assayed for IFN-gamma by ELISA. Supernatants harvested from both the splenocytes from the "UL47 DNA" mice (those that were immunized) and the "UL47 DNA/HSV" mice (those that were immunized followed by infection with HSV) had significant levels of IFN-gamma present compared to the "HSV control" mice (those who were uninmmunized and infected).

A further four mice were immunized four times with UL47 DNA and their splenocytes harvested. The splenocytes were then stimulated with peptides p85, p89, p98, p99, p105, and p112 and the CD8+ cells assayed for the presence of intracellular IFN-gamma production using flow cytometry. The percentages of CD8+ cells producing IFN-gamma were significant in the splenocytes stimulated with peptides p85, p89, p98, p99, p105 and p112, compared to the control cells (cells stimulated with media or PBS alone). Reponses seen against peptides p98 and p99 should the highest percentages, with greater than 2% of all CD8+ splenocytes positive for intracellular IFN-gamma.

These data further demonstrate the effectiveness of UL47 as a vaccine candidate in the protection against or treatment of HSV infection.

Example 14

CD8+ T Cell Responses from HSV-2 Seropositive Donors

Six HSV-2 seropositive donors were screened to determine which HSV-2 proteins were capable of eliciting a CD8+ T cell response. The donors included: AD104, AD116, AD120, D477, HV5101, and JH6376. In order to determine which HSV-2 proteins were immunogenic, synthetic peptides (15-mers overlapping by 11 amino acids) were synthesized across the following region of several HSV-2 polypeptides, including: UL15 (a.a. 600–734), UL18 (a.a. 1–110), UL23 (a.a. 241–376), UL46 (a.a. 617–722), UL47 (a.a. 1–696), UL49 (a.a. 1–300), ICP27 (a.a. 1–512), US3 (a.a. 125–276), and US8A (a.a. 83–146). Peptides synthesized for UL47, UL49, and ICP27 spanned the full-length polypeptide. Peptides synthesized for UL15, UL18, UL23, UL46, US3, and US8A spanned the portions of these polypeptides previously determined to encode antigens recognized by CD4+ T cells during CD4 expression-cloning library screening.

The donors CD8+ T cells were isolated from PBMC using the following procedure: initially peripheral blood lymphocytes (PBL) were separate from macrophages using plastic adherence. The CD8+ T cells were then further purified by depletion of non-CD8+ cells using a commercial MACS bead kit (Miltenyi). CD8+ T cells isolated using this method are generally >95% CD8+/CD3+/CD4−, as measured by flow cytometry (FACS). Peptides were screened by 24-hour co-culture of CD8+ T cells ($2 \times 10^5$/well), autologous dendritic cells ($1 \times 10^4$/well), and peptides (10 μg/ml each) in 96 well ELISPOT plates pre-coated with anti-human IFN-gamma antibody. Peptides were initially screened as pools of ≧10 peptides. ELISPOT plates were subsequently developed per a standard protocol. The numbers of spots per well were counted using an automated video-microscopy ELISPOT reader. Peptide from pools screening positive were subsequently tested individually in a second ELISPOT assay.

For AD104, only the peptide US3 #33 (SEQ ID NO:139: amino acids 262–276) scored positive.

For AD116, peptides UL15 #23 (SEQ ID NO:127: amino acids 688–702), UL15 #30 (SEQ ID NO:128: amino acids 716–730), UL23 #7 (SEQ ID NO:129: amino acids 265–272), UL46 #2 (SEQ ID NO:130: amino acids 621–635), UL46 #8 (SEQ ID NO:131: amino acids 645–659), UL46 #9 (SEQ ID NO:132: amino acids 649–663), UL46 #11 (SEQ ID NO:133: amino acids 657–671), UL47 #86 (SEQ ID NO:134: amino acids 341–355), UL49 #6 (SEQ ID NO:135: amino acids 21–35), UL49 #49 (SEQ ID NO:138: amino acids 193–208), and US8A #5 (SEQ ID NO:140: amino acids 99–113) scored positive both pooled and individually. In addition, AD116 also recognized the B*0702-restricted epitope UL49 #12 (SEQ ID NO:136: amino acids 45–59) and UL49 #13 (SEQ ID NO:137: amino acids 49 to 63).

Donors D477, HV5101, and JH6376 T cells recognized the HLA-A*0201-restricted epitopes UL47 #73/#74 (amino acids 289–297) and UL47 #137/#138 (amino acids 550–559), respectively.

Donor AD120 scored positive for one peptide pool, UL46 #1–12.

Donor D477 scored positive for 5 peptide pools: UL18 #1–12, UL23 #1–10, UL23 #11–20, UL46 #1–12, and UL49 #11–20.

Example 15

Identification of a Novel Sequence Coding for the US4 Protein of HSV-2

Screening the HSV2-II library with T cells from donor AD104 had previously identified the clone insert F10B3 (see Example 1 for details). SEQ ID NO:8, corresponds to the partial sequence of the insert from clone HSV2II_US3/US4 fragF10B3_T7Trc.seq, and contains a potential open reading frame having an amino acid sequence set forth in SEQ ID NO: 10. The full-length DNA and amino acid sequences corresponding to the insert sequence are disclosed in SEQ ID NOs:141 and 142, respectively. The full length US4 HG52 DNA and amino acid sequence are disclosed in SEQ ID NO:179 and 143, respectively, and differs from the insert sequence as follows: S35N (HG52/location/333).

Example 16

Identification of HSV-2-Specific CD8+ T Cell Responses in HSV-2

CD8+ T cells isolated from a panel of HSV-2 seropositive donors were screened for their ability to respond to a variety of HSV-2 proteins. Briefly, PBMCs were obtained from donors EB5491, AG10295, LM10295, and 447, and enriched for CD8+ T cells using microbeads or CD8+ Enrichment Kits from Miltenyi. Synthetic peptides (15 amino acids in length and overlapping in sequence by 10 or 11 amino acids) were synthesized across several complete or partial ORFs from HSV-2 strain HG52, including proteins UL21 (the full length DNA/amino acids of which are disclosed in SEQ ID NOs:.144 and 154, respectively), UL50 (the full length DNA/amino acids of which are disclosed in SEQ ID NOs:.145 and 153, respectively), US3 (the full length DNA/amino acids of which are disclosed in SEQ ID NOs:.146 and 154, respectively), UL54 (the full length DNA/amino acids of which are disclosed in SEQ ID NOs:.147 and 156, respectively), US8 (the full length DNA/amino acids of which are disclosed in SEQ ID NOs:.148 and 157, respectively), UL19 (the full length DNA/amino acids of which are disclosed in SEQ ID NOs:.149 and 158, respectively), UL46 (the full length DNA/amino acids of which are disclosed in SEQ ID NOs:.150 and 159, respectively), UL18 (the full length DNA/amino acids of which are disclosed in SEQ ID NOs:.151 and 160, respectively), and RL2 (the full length DNA/amino acids of which are disclosed in SEQ ID NOs:.152 and 161, respectively). The peptides were screened by 24 co-culture of the donor's CD8+ T cells (2–5×10$^5$ cells/well), autologous dendritic cells (2–5×10$^4$ cells/well) and peptides (0.5 µg/ml each) in 96-well ELISPOT plates that had been pre-coated with anti-human IFN-γ antibody. Each peptide pool was screened in an individual well. The ELISPOT plates were developed as per a standard protocol. The number of spots per well was counted using an automated video-microscopy ELISPOT reader. Individual 15-mer peptides, determined from peptide pools testing positive, were screened as described above and returned the following results:

Donor EB5491 demonstrated CD8+ T cell responses to the HSV-2 antigens: ICP0 peptide #43 (amino acids 211–225: IWTGNPRTAPRSLSL: SEQ ID NO:162). UL46 peptides #41 (amino acids 201–215: YMFFMR-PADPSRPST: SEQ ID NO:163), UL46 #50 (amino acids 246–260: VCRRLGPADRRFVAL: SEQ ID NO:164), UL46 #51 (amino acids 251–265: GPADRRFVALSGSLE: SEQ ID NO:165), and UL46 #60 (amino acids 296–310: SDV-LGHLTRLAHLWE: SEQ ID NO:166). Donor EB5491 also demonstrated a CD8+ T cell response to the HSV-2 protein, US8 #74 (amino acids 366–380: HGMTISTMQYRNAV: SEQ ID NO:167).

Donor JH6376 demonstrated CD8+ T cells responses to the HSV-2 proteins ICP0, which corresponded to a 9-mer mapped to amino acids 215–223 (NPRTAPRSL: SEQ ID NO:177) and UL46, which corresponded to a 10-mer mapped to amino acids 251–260 (GPADRRFVAL: SEQ ID NO:178).

Donor AG1059 demonstrated CD8+ T cell responses to the HSV-2 proteins UL19 peptide 102 (amino acids 506–520: LNAWRQRLAHGRVRW: SEQ ID NO:168), UL19 #103 (amino acids 511–525: QRLAHGRVRW-VAECQ: SEQ ID NO:169) and UL18 #17 (amino acids 65–79: LAYRRRFPAVITRVL: SEQ ID NO:172) and UL18 #18 (amino acids 69–83: RRFPAVITRVLPTRI: SEQ ID NO:173).

Donor LM10295 demonstrated CD8+ T cell responses to the HSV-2 protein UL19 #74 (amino acids 366–380: DLVAIGDRLVFLEAL: SEQ ID NO:170) and UL19 #75 (amino acids 371–385: GDRLVFLEALERRIY: SEQ ID NO:171).

Donor 477 demonstrated CD8+ T cell responses to the HSV-2 protein UL50 #16 (amino acids 76–90: CAII-HAPAVSGPGPH: SEQ ID NO:174), UL50 #23 (amino acids 111–125: PNGTRGFAPGALRVD: SEQ ID NO:175), and UL50 #49 (amino acids 241–255: LRVL-RAADGPEACYV: SEQ ID NO:176).

Example 17

Expression of a Truncated Form of UL47 in *E. Coli*

A C-terminal truncation of the full length UL47 coding region was expressed in *E. coli*, and designated as UL47F. This truncated portion of UL47 contains the C-terminal T cell epitope of UL47, corresponding to amino acids 500–559.

Expression of HSV UL47 F in *E. coli:*

The HSV UL47F coding region (the DNA and amino acid sequences of which are disclosed in SEQ ID NO:180 and 181, respectively) was PCR amplified using the following primers:

```
                                          (SEQ ID NO:182)
CBH-631: 5'ctgggtctggctgacacggtggtcgcgtgcgtg3'

(SEQ ID NO:183)
PDM-632: 5'ccgttagaattcactatgggcgtggcgggcc3'
```

The PCR was Performed with the Following Reaction Components:
10 µl 10×Pfu buffer
1 µl 10 mM dNTPs
2 µl 10 µof each primer
83 µl of sterile water
1.5 µl Pfu DNA polymerase (Stratagene, La Jolla, Calif.)
50 ng DNA PCR Amplification was Performed Using the Following Reaction Conditions:
96° C. for 2 minutes, followed by 40 cycles of:
96° C. for 20 seconds;
68° C. for 15 seconds; and
72° C. for 1 minute and 30 seconds, followed by a final extension step of:
72° C. for 4 minutes.

The PCR product was digested with EcoRI and cloned into pPDM His that had been cut with Eco72I and EcoRI. The sequence of the construct was confirmed, and then the construct was transformed into BRL pLys S and BLR CodonPlus RP cells.

Example 18

Identification of Novel Antigens from HSV-2 Recognized by Human CD8+ T Cells

This example illustrates the identification of multiple immunogenic HSV-2 antigens using ELISPOT screening of HSV-2 peptides. These findings identify HSV-2 antigens capable of eliciting a cellular immune response in vivo. Identification of such antigens allows for the development of vaccines to protect against HSV-2 infection, as well as compounds that can be used in the treatment of HSV-2 infection.

A panel of HSV-2 seropositive donors including AD104, AD116, D574, G110897, RW1874, YS10063, AC10022, LB10802, NH9894, PA10939, VB10576, MA11259 (seronegative), and JG10758 (described in detail in Table 4) were used to identify immunogenic portions of HSV-2.

Blood was obtained from each donor and peripheral blood mononuclear cells (PBMCs) were isolated using a Ficoll gradient. The PBMCs were washed thoroughly with PBS/EDTA, and suspended in a 10% DMSO/50% FBS/40% RPMI solution and frozen.

TABLE 4

| Donor | Serol. status | Shedding Status | HLA-A | HLA-B | HLA-Cw | HLA-DRB1 | HLA-DQB1 |
|---|---|---|---|---|---|---|---|
| AD104 | 1− | Unknown | 24 | 46 | 01 | 04 | 03 |
| 413 | 2+ | | 33 | 58 | 0302 | 09 | 04 |
| AD116 | 1− | Unknown | 0206 | 0702 | 0702 | 0408 | 0304 |
| 421 | 2+ | | 24 | 35 | 1203 | 1501 | 0602 |
| D574 | 1 | Unknown | 11 | 27 | 02 | 0407 | 0301 |
| 146 | 2+ | | 68 | 55 | 03 | 0901 | 0303 |
| RW1874 | 1− | Frequent | 0101 | 0801 | 0701 | 03 | 2 |
| | 2+ | | 0201 | 4501 | 16 | 11 | 3 |
| YS10063 | 1+ | Infrequent | 02 | 35 | 03 | 0301 | 0201 |
| | 2+ | (0) | 33 | 58 | 04 | 1401 | 0503 |
| AC10022 | 1− | Frequent | 02 | 27 | 01 | 0101 | 0301 |
| | 2+ | | | 37 | 06 | 1104 | 0501 |
| JG10758 | 1+ | Frequent | 01 | 08 | | 0101 | 0201 |
| | 2+ | | 02 | 51 | | 0301 | 0501 |
| GI10897 | 1+ | | 02 | 35 | | 1104 | 0301 |
| | 2+ | | 24 | | | 1401 | 0503 |
| PA10939 | 1− | Infrequent | 02 | 44 | 05 | 0101 | 0501 |
| | 2+ | Cult 2/70 | 31 | 14 | 08 | 0102 | |
| VB10576 | 1− | Infrequent | 24 | 35 | | 1104 | 0301 |
| | 2+ | Cult 3/50 | 26 | | | 0407 | |
| NH9894 | 1− | Infrequent | 29 | 44 | 07 | 0401 | 0301 |
| | 2+ | Cult 2/46 | 68 | 63 | 14 | 1101 | |
| LB10802 | 1+ | Infrequent | 29 | 44 | 04 | 0401 | 0301 |
| | 2+ | Cult 0/26 | 68 | 35 | 07 | 1104 | 0302 |
| MA1125 | 1+ | N/A | 01 | 51 | 02 | 0701 | 0202 |
| 9 | 2− | | 02 | 58 | 07 | | |

Synthetic peptides (15 amino acids in length and overlapping by 10 or 11 amino acids) were synthesized across several complete or partial open reading frames (ORFs) from the HG52 strain of HSV-2. These ORFs included UL18 (the DNA and amino acid sequences of which are disclosed in SEQ ID NOs:184 and 195, respectively), LAT-ORF1 (the DNA and amino acid sequences of which are disclosed in SEQ ID NOs:185 and 198, respectively), UL48 (the DNA and amino acid sequences of which are disclosed in SEQ ID NOs:186 and 205, respectively), UL41 (the DNA and amino acid sequences of which are disclosed in SEQ ID NOs:187 and 204, respectively), UL39 (the DNA and amino acid sequences of which are disclosed in SEQ ID NOs:188 and 203, respectively), UL37 (the DNA and amino acid sequences of which are disclosed in SEQ ID NOs:189 and 202, respectively), UL36 (the DNA and amino acid sequences of which are disclosed in SEQ ID NOs:190 and 201, respectively), UL29 (the DNA and amino acid sequences of which are disclosed in SEQ ID NOs:191 and 200, respectively), UL25 (the DNA and amino acid sequences of which are disclosed in SEQ ID NOs:192 and 199, respectively), ICP4 (the DNA and amino acid sequences of which are disclosed in SEQ ID NOs:193 and 197, respectively), ICP0 (the DNA and amino acid sequences of which are disclosed in SEQ ID NOs:35 and 47, respectively), US3 (the DNA and amino acid sequences of which are disclosed in SEQ ID NOs:146 and 154, respectively) and ICP22 (the DNA and amino acid sequences of which are disclosed in SEQ ID NOs:194 and 196, respectively). Individual 15-mer peptide stocks were made by dissolving each peptide at a concentration of 10 mg/ml in DMSO. Peptide pools containing between 16–90 peptides/pool were made from the individual peptide stocks by combining individual peptides at 100 µg/ml.

The peptide pools were screened against CD8+ T cells enriched from the individual donors' PBMCs. CD8+ T cell enriching was performed using either CD8+ microbeads or CD8+ enrichment kits from Miltenyi, as per the manufacturer's instructions. The peptides were screened by 24-hour co-culture of CD8+ T cells ($5\times10^5$/well), autologous dendritic cells ($5\times10^4$/well) and peptide pools (0.5 µg/ml each) in 96-well ELISPOT plates that had been pre-coated with anti-human IFN-γ antibody. Each peptide pool was screened in an individual well. ELISPOT plates were subsequently developed per a standard protocol, and the number of spots per well counted using an automated video-microscopy ELISPOT reader.

The following donors responded to the following HSV-2 antigens and peptide pools:

Donor LB10802 responded to UL39, peptide pools C (amino acids 501–760) and D (amino acids 751–1142), UL21, peptide pools B (amino acids 260–530), UL19, peptide pools E (amino acids 1001–1374) and B (amino acids 251–510), and ICP0, pool C (amino acids 499–825).

Donor PA10939 responded to UL25, peptide pool B (amino acids 251–585), UL47, peptide pool C (amino acids 401–696) and UL46, peptide pool C (amino acids 500–722.

Donor NH9894 responded to UL39, peptide pool C (amino acids 501–760), UL36, peptide pool G (amino acids 2671–3122), UL29, peptide pool C (amino acids 501–760), UL25, peptide pool A (amino acids 1–260), UL49, amino acids 1–300, UL47, peptide pool C (amino acids 401–696), UL46, peptide pool B (amino acids 251–510), UL19, peptide pool D (amino acids 751–1010), and ICP0, peptide pool A (amino acids 1–259).

Donor 574 responded UL39, peptide pool D (amino acids 751–1142), UL18 (amino acids 1–318), and ICP0, peptide pool B (amino acids 251–510).

Donor AD104 responded UL29, peptide pool C (amino acids 501–760), UL25, peptide pool A (amino acids 1–260), and ICP4, peptide pool D (amino acids 751–1010.

Donor YS10063 responded UL25, peptide pool B (amino acids 251–585), US3, amino acids 163–481, UL47 peptide pools C (amino acids 401–696) and B (amino acids 201–411), UL19, peptide pool C (amino acids 501–760) and ICP0, peptide pools C (amino acids 499–825) and A (amino acids 1–259).

Donor JG10758 responded to UL39, peptide pool C (amino acids 501–760).

Donor AD116 responded to UL41, peptide pool A (amino acids 1–260) and ICP22, peptide pool B (amino acids 206–413.

Donor VB10576 responded to LAT-1, peptide pool B (amino acids 42–82), UL39, peptide pool C (amino acids 501–760), UL36, peptide pools A (amino acids 1–455) and C (amino acids 889–1345), ICP22, peptide pool B (amino acids 206–413), UL19, peptide pools C (amino acids 501–760) and A (amino acids 1–260), ICP27, peptide pool B (amino acids 253–512), and ICP0, peptide pool C (amino acids 499–825).

Donor GI110897 responded to UL39, peptide pools C (amino acids 501–760) and A (amino acids 1–260), UL37, peptide pool C (amino acids 501–760), UL36, peptide pool C (amino acids 889–1345), and UL25, peptide pool B (amino acids 251–585).

Donor RW1874 responded to UL41, peptide pool B (amino acids 251–492), UL39, peptide pool C (amino acids 501–760), and UL25, peptide pool B (amino acids 251–585).

Donor AC10022 responded to UL18 amino acids 1–318, and ICP4, peptide pools D (amino acids 751–1010) and B (amino acids 251–510.

Donor MA11259 (HSV sero-negative donor) responded to UL39, peptide pool C (amino acids 501–760), ICP27, peptide pool B (amino acids 253–512), and ICP0, peptide pool A (amino acids 1–259).

Example 19

Identification of HSV-2 Antigens Using CD4+ T Cell Cloning

Donor HH is a HSV-2 exposed, but uninfected, seronegative donor. The generation of a HSV-2 specific CD4+ T cell line was previously described in Example 6. This example illustrates the identification of immunoreactive HSV-2 antigens using T cell expression cloning of E. coli gene-fragment expression libraries. These libraries were generated using the 333 strain of HSV-2. These experiments were performed essentially as described in Example 11.

Three distinct library inserts were identified from the HSV-2 library:

Inserts 1/A7 amd 1/F3 span the corresponding HSV-2 (strain HG52) genome at base-pairs 36,168–37,605 (the DNA sequence of which is disclosed SEQ ID NO:206); insert 1/H6 spans base-pairs 36,055–37,354 (the DNA sequence of which is disclosed in SEQ ID NO:207); and insert 3/C1 spans base-pairs 36,473–37,727 (the DNA sequence of which is disclosed in SEQ ID NO:208).

Each of these inserts encodes a fragment of the C-terminus of UL19 (also referred to as VP5 or ICP). The full length DNA and amino acid sequences for UL19 are disclosed in SEQ ID NOs:210 and 212, respectively. The sequence shared by all three library inserts spans the corresponding HSV-2 (HG52 strain) genome at base-pairs 36,473–37,354 (the DNA and amino acid sequence of which is described in SEQ ID NOs:209 and 211, respectively.

The UL19 ORF spans the genomic sequence of HG52 at base-pairs 36,448–40,572, and encodes the major capsid protein of HSV-2. There are three nucleotide differences between the shared region encoded by the library inserts (derived from HSV-2 strain of 333) and the corresponding UL19 sequence from HG52: A36710G, G37248C, and C37317T (333/position/HG52). The first two nucleotide substitutions result in amino acid substitutions, the third does not. The substitutions are N to S and G to A (HG52 to 333), respectively.

Example 20

HSV-2 US8 Gene Sequence from Clinically Isolated Viral DNA

The DNA sequence corresponding to the US8 gene of HSV-2 was cloned from the laboratory HG52 viral strain and sequenced, the DNA and its corresponding amino acid sequences are disclosed in SEQ ID NOs:118 and 120, respectively. The details of these experiments are described in Example 12. SEQ ID NO:118 was then compared to the HSV-2 HG52 strain genomic sequence contained in GenBank (accession number Z86099), the DNA and amino acid sequences of which are disclosed in SEQ ID NOs:119 and 121, respectively. This comparison revealed that SEQ ID NO:118 contained an extra base pair at position 542 that resulted in a frameshift. The presence of this extra base pair was also confirmed in a second laboratory strain of HSV-2, 333. There was one additional base pair (bp 156) upstream of the first stop codon in SEQ ID NO:118 that differed from the GenBank US8 sequence (SEQ ID NO:119). No change in the US8 amino acid sequence would result from the change in the nucleotide sequence at base pair 156. The full-length US8 gene was sequenced from two clinical isolates, donors RW1874 and HV5101. In order to derive these sequences, PCR products from each clinical viral DNA isolate were cloned and ligated into a plasmid vector for sequencing. The vector contained an upstream fusion partner (Ra12/thrombin site) to enhance potential protein expression and provide a cleavage site, thus the clinical US8 gene sequences are lacking a starting ATG (Met) codon sequence so as to eliminate redundancy. The plasmid DNA containing each of these clones was sequenced using DNA primers specific for both vector and predicted internal sequence.

The full length US8 DNA and amino acid sequences for RW1874 are disclosed in SEQ ID NOs:213 and 215, and the full length US8 DNA and amino acid sequences for HV5101 are disclosed in SEQ ID NOs:214 and 216, respectively. These sequences were then compared with the published laboratory strain of HSV-2, HG52, the results of which are described in Table 5.

TABLE 5

| nt position corresponding to HG52 sequence | RW1874/nt substitutions | RW1874/aa substitutions | HV5101/nt substitutions | HV5101/aa substitutions |
|---|---|---|---|---|
| 1 | ATG site removed | NA | ATG site removed | NA |
| 129 | 9 bp insert | Gly/Pro/Glu insert | 9 bp insert | Gly/Pro/Glu insert |
| 551 | Bp insert of G, resulting in frameshift | SerGluArgThr ProValSerVal ProProProThr | Bp insert of G, resulting in frameshift | SerGluArgThr ProValSerVal ProProAlaThr |
| 584 | bp deletion of C, results in a second frameshift that restores original reading frame | — | bp deletion of C, results in a second frameshift that restores original reading frame | — |
| 681 | T to C | Leu to Pro | T to C | Leu to Pro |
| 814 | T to G | Asp to Glu | T to G | Asp to Glu |
| 1083 | — | — | T to C | Val to Ala |
| 1156 | A to G | Glu to Glu | — | — |
| 1221 | A to C | His to Pro | — | — |
| 1262 | G to A | Val to Met | — | — |

The differences observed in these clinical isolates provides valuable information on areas of sequences that are both highly conserved or demonstrate variability. This sequence information provides valuable information that can be exploited in the development of therapeutic or diagnostic antibodies for the treatment and prevention of HSV/HSV-2 infection. Variability in sequence of HSV-2 genes is largely unknown. This sequence information also provides valuable information for selection of an antigen or antigens for use in a vaccine that is to identify HSV-2 sequences that are most clinically representative and relevant.

Example 21

Identification of HSV-2 Antigens Using CD4+ T Cell Cloning

This Example describes the further characterization of CD4[+] T cell clones generated from donor HH, who is an HSV-2 exposed, but seronegative donor. The generation of these T cell clones is described in detail in Example 6.

Clone HH6 was found to recognize UL21 presented by the HSV-2-III library, pool 3H11, in addition to pool D6 that was derived from the HSV2-II library. The insert DNA sequence and corresponding protein sequence are disclosed in SEQ ID NOs:217 and 227, respectively. These sequences were derived from the 333 strain of HSV2. The DNA sequence spans base pairs 42,908–44,296 of the homologous region in the HG52 viral genome. Full length DNA and protein sequences of UL21 derived from the HG52 strain of HSV-2 are disclosed in SEQ ID NOs:218 and 228. Using 15-mer peptides overlapping by 10 amino acids, T cells from clone HH6 were tested for their ability to react when stimulated with the HSV-2 peptides in an ELISPOT assay. Results demonstrated that the reactive T cell epitope was located within the UL21 gene between amino acids 281–300. The amino acids corresponding to this region of the sequence are:PLRELWWVFYAGDRALEEPH (SEQ ID NO:229).

Clone HH 20 was found to recognize a fragment of HSV-2 ORF, UL29. This clone was found to contain two UL29-encoding inserts, both of which were derived from the HG52 strain. The full length DNA and protein sequences of UL29 derived from the HG52 strain of HSV-2 are disclosed in SEQ ID NOs:221 and 232, respectively. The first insert, clone 1/C12_E1 (SEQ ID NO:219) spans base pairs 61,539–62,299 of the HG52 viral genome and encodes UL29 amino acids 48–303 (SEQ ID NO:230). The second insert, 2/E9_D11 (SEQ ID NO:220), spans base pairs 61,538–62360 of the HG52 viral genome and encodes UL29, amino acids 30–303 (SEQ ID NO: 231). The sequence of this insert differs from HG52 as follows: R121 P and S126A (333/location/HG52).

Clone HH 22 recognized a fragment of the HSV-2 ORF of UL46 and was found to contain two inserts. The full-length DNA and amino acid sequences of UL46, derived from the HG52 strain of HSV-2, are disclosed in SEQ ID NOs:224 and 235, respectively. The first insert, F7_A1, derived from the HG52 strain of HSV-2, was found to span base pairs 99,253 to 100,014 of the homologous region in the HG52 viral genome and encodes UL46/amino acids 529–722. The DNA and amino acid sequence encoded by insert F7_A1 are disclosed in SEQ ID NOs:222 and 233, respectively. The amino acid sequence of the F7_A1 insert differs from HG52 as follows: -590A, S613G, L643P, Q637R, D638L, P644L, P672R, G673R (333/location/HG52). The second insert, 4/E8_C8, derived from the HG52 strain of HSV-2 spans 99,232 to 100,262 of the HG52 viral genome and encodes UL46/amino acids 446–722. The DNA sequence of the insert and the amino acid sequence it encodes are disclosed in SEQ ID NOs:223 and 234, respectively. The location of a T cell epitope was mapped by screening 15-mer peptides overlapping by 10 amino acid in an ELISPOT assay and is located within UL46/621–649 (EEIPWVRVYENICLRRQDA: SEQ ID NO:236).

Clone HH24 recognized a fragment of HSV-2 ORF UL47, the full-length DNA and amino acid sequences from the HG52 strain of HSV-2 are disclosed in SEQ ID NOs:226 and 238, respectively. The DNA sequence of the insert G6_H11 (SEQ ID NO:225 which encodes SEQ ID NO:237) spans base pairs 101,622 to 103,386 of the homologous region of the HG52 viral genome. The location of the T cell epitope was mapped by screening 15-mer peptides overlapping by 10 amino acids in an ELISPOT assay and is located with UL47/amino acids 137–155 (LGRVGGSRWPSPLFLDEL: SEQ ID NO:239).

Example 22

Identification of HSV-2 Antigens Using CD4+ T Cell Cloning

CD4+ T cells were generated from an HSV-2 seropositive donor, TM, who has suffered from infrequent genital lesion recurrences and sheds virus infrequently (as assessed by both virus cultures and PCR on daily swabs). TM clones were derived by stimulation of PBMCs with UV-inactivated HSV-2, strain 333, for 14 days, followed by limiting dilution cloning on anti-CD3 mAb. Clones were subsequently tested for reactivity with UV-inactivated HSV-2 and a panel of recombinant HSV-2 proteins.

Clones TM13 and TM58 recognize the same fragment of HSV-2 ORF UL54, also known as ICP27. The DNA and amino acid sequences corresponding to the insert 3/F5_G1 are disclosed in SEQ ID NOs:240 and 241, respectively. The corresponding HG52 DNA sequence spans base pairs 115,061 to 115,785 of the viral genome and encodes a fragment of UL54. The corresponding HG52 sequence for full-length UL54 is disclosed in SEQ ID NO:242. The actual amino acid sequence encoded by 3/F5_G1 (SEQ ID NO:241) corresponds to HG52 amino acids 159–399. The corresponding HG52 amino acid sequence for full-length UL54 is disclosed in SEQ ID NO:243. The 3/F5_G1 insert sequence differs from the HG52 UL54 sequence by a single amino acid, N169K (333/location/HG52).

Clone TM39 recogized an insert comprised of two genomic fragments of HSV-2. The DNA sequence for the insert 3/H11 _C3 is disclosed in SEQ ID NO:244. The corresponding HG52 DNA sequences spanned include base pairs 43,717 to 44,086 and 70,294 to 71,846 of the viral genome. The first fragment, base pairs 70,294 to 71,846, encodes portions of HG52 UL21 and UL22. Base pairs 43,717 to 44,086, encodes portions of UL36. The corresponding full length DNA sequences for Ul21, UL22, and UL36 are disclosed in SEQ ID NOs:245–247, respectively. The corresponding full length HG52 amino acid sequences for UL21, UL22, and UL36 are disclosed in SEQ ID NOs:248–250, respectively.

Clone TM51 recognized a fragment of HSV-2 ORF US4. The DNA sequence of the insert derived from TM51, F7_A8, is disclosed in SEQ ID NO:251. The corresponding HG52 DNA sequence spans base pairs 139,505 to 140,104 of the viral genome and encodes a fragment of US4. The corresponding HG52 DNA sequence is disclosed in SEQ ID NOs:252. The amino acid sequence encoded by F7_A8 is disclosed in SEQ ID NO:253, and corresponds to HG52 US4 amino acids 544–699. The corresponding hg52 amino acid sequence for the full length US4 sequence is disclosed in SEQ ID NO:254. The F7_A8 inset and HG52 amino acid sequence differ by a single amino acid, D56E (333/location/HG52).

Those skilled in the art will appreciate that the conceptions and specific embodiments disclosed in the foregoing description may be readily utilized as a basis for modifying or designing other embodiments for carrying out the same purposes of the present invention. Those skilled in the art will also appreciate that such equivalent embodiments do not depart from the spirit and scope of the invention as set forth in the appended claims.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (254 sequences)

SEQ ID NO: 1 - DNA, 815 bp, Herpes simplex virus
ccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctggggattctggttcacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggttcctggcgtgccgggcgacccgcggcatgcgccacatcgccctggggcgacaggggtcgtggtgggaaatgttcaagttctttttccaccgcctctacg

SEQ ID NO: 2 - protein, 271 aa, Herpes simplex virus
HAAAPQADVAPVLDSQPTVGTDPGYPVPLELTPENAEAVARFLGDAVDREPALMLEYFCRCAREESKRVPPRTFGSAPRLTEDDFGLLNYALAEMRRLCLDLPPVPPNAYTPYHLREYATRLVNGFKPLVRRSARLYRILGILVHLRIRTREASFEEWMRSKEVDLDFGLTERLREHEAQLMILAQALNPYDCLIHSTPNTLVERGLQSALKYEEFYLKRFGGHYMESVFQMYTRIAGFLACRATRGMRHIALGRQGSWWEMFKFFFHRLY

SEQ ID NO: 3 - protein, 1142 aa, Herpes simplex virus
MANRPAASALAGARSPSERQEPREPEVAPPGGDHVFCRKVSGVMVLSSDPPGPAAYRISDSSFVQCGSNCSMIIDGDVARGHLRDLEGATSTGAFVAISNVAAGGDGRTAVVALGGTSGPSATTSVGTQTSGEFLHGNPRTPEPQGPQAVPPPPPPPFPWGHECCARRDARGGAEKDVGAAESWSDGPSSDSETEDSDSSDEDTGSETLSRSSSIWAAGATDDDDSDSDSRSDDSVQPDVVVRRRWSDGPAPVAFPKPRRPGDSPGNPGLGAGTGPGSATDPRASADSDSAAHAAAPQADVAPVLDSQPTVGTDPGYPVPLELTPENAEAVARFLGDAVDREPALMLEYFCRCAREESKRVPPRTFGSAPRLTEDDFGLLNYALAEMRRLCLDLPPVPPNAYTPYHLREYATRLVNGFKPLVRRSARLYRILGVLVHLRIRTREASFEEWMRSKEVDLDFGLTERLREHEAQLMILAQALNPYDCLIHSTPNTLVERGLQSALKYEEFYLKRFGGHYMESVFQMYTRIAGFLACRATRGMRHIALGRQGSWWEMFKFFFHRLYDHQIVPSTPAMLNLGTRNYYTSSCYLVNPQATTNQATLRAITGNVSAILARNGGIGLCMQAFNDASPGTASIMPALKVLDSLVAAHNKQSTRPTGACVYLEPWHSDVRAVLRMKGVLAGEEAQRCDNIFSALWMPDLFFKRLIRHLDGEKNVTWSLFDRDTSMSLADFHGEEFEKLYEHLEAMGFGETIPIQDLAYAIVRSAATTGSPFIMFKDAVNRHYIYDTQGAAIAGSNLCTEIVHPASKRSSGVCNLGSVNLARCVSRQTFDFGRLRDAVQACVLMVNIMIDSTLQPTPQCTRGNDNLRSMGIGMQGLHTACLKMGLDLESAEFRDLNTHIAEVMLLAAMKTSNALCVRGARPFSHFKRSMYRAGRFHWERFSNASPRYEGEWEMLRQSMMKHGLRNSQFIALMPTAASAQISDVSEGFAPLFTNLFSKVTRDGETLRPNTLLLKELERTFGGKRLLDAMDGLEAKQWSVAQALPCLDPAHPLRRFKTAFDYDQELLIDLCADRAPYVDHSQSMTLYVTEKADGTLPASTLVRLLVHAYKRGLKTGMYYCKVRKATNSGVFAGDDNIVCTSCAL

SEQ ID NO: 4 - DNA, 208 bp, Herpes simplex virus
gcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggcca

SEQ ID NO: 5 - protein, 64 aa, Herpes simplex virus
GAAPACRRPPRGGSPAAFPVALHAVDAPSQFVTWLAVRWLRGAVGLGAVLCGIAFYVTSIARGA

SEQ ID NO: 6 - protein, 70 aa, Herpes simplex virus
RRARVPQTTSRRLPRGLSRGPPRRGRPLPIRHLARRALAAGGGGSRGRPVRDCVLRDVNRPRRIKVRRPA

SEQ ID NO: 7 - protein, 146 aa, Herpes simplex virus
MDPALRSYHQRLRLYTPIARGVNLAARSPPLVREARAVVTPRPPIRPSSGKASSDDADVGDELIAIADARGDPPETLPPGAGGAAPACRRPPRGGSPAAFPVALHAVDAPSQFVTWLAVRWLRGAVGLGAVLCGIAFYVTSIARGA

SEQ ID NO: 8 - DNA, 137 bp, Herpes simplx virus
ccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttcc

SEQ ID NO: 9 - DNA, 430 bp, Herpes simplex virus
atggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgaaccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatatta

SEQ ID NO: 10 - protein, 22 aa, Herpes simplex virus
WTGRHFGPSAAGASPLRPWQNW

SEQ ID NO: 11 - protein, 143 aa, Herpes simplex virus
MDREALRAISRGCKPPSTLAKLVTGLGFAIHGALIPGSEGCVFDSSHPNYPHRVIVKAGWYASTNHEARLLRRLNHPAILPLLDLHVVSGVTCLVLPKYHCDLYTYLSKRPSPLGHLQITAVSRQLLSAIDYVHCEGIIHRDI

SEQ ID NO: 12 - protein, 481 aa, Herpes simplex virus
MACRKFCGVYRRPDKRQEASVPPETNTAPAFPASTFYTPAEDAYLAPGPPETIHPSRPPSPGEAARLCQLQEILAQMHSDEDYPIVDAAGAEEEDEADDDAPDDVAYPEDYAEGRFLSMVSAAPLPGASGHPPVPGRAAPPDVRTCDTGKVGATGFTPEELDTMDREALRAISRGCKPPSTLAKLVTGLGFAIHGALIPGSEGCVFDSSHPNYPHRVIVKAGWYASTSHEARLLRRLNHPAILPLLDLHVVSGVTCLVLPKYHCDLYTYLSKRPSPLGHLQITAVSRQLLSAIDYVHCKGIIHRDIKTENIFINTPENICLGDFGAACFVRGCRSSPFHYGIAGTIDTNAPEVLAGDPYTQVIDIWSAGLVIFETAVHTASLFSAPRDPERRPCDNQIARIIRQAQVHVDEFPTHAESRLTAHYRSRAAGNNRPAWTRPAWTRYYKIHTDVEYLICKALTFDAALRPSAAELLRLPLFHPK

SEQ ID NO: 13 - DNA, 501 bp, Herpes simplex virus
gggggcgcgtctacgaggagatcccctgggttcgggtatacgaaaacatctgccttcgccggcaagacgccggcggggcggccccgccgggagacgccccggactccccgtacatcgaggcggaaaatcccctgtacgactggggcgggtctgccctcttctcccctccgggggccacacgcgccccggacccgggactaagcctgtcgcccatgcccgcccgcccccggaccaacgcgctggccaacgacggcccgacaaacgtcgccgccctcagcgccctgttgacgaagctcaaacgcggccgacaccagagccattaaaaaaatgcgaccgccggccccaccgtctcggtttccggcccctttccccgtatgtctgttttcaataaaaagtaacaaacagagaaaaaaaaacagcgagttccgcatggtttgtcgtacgcaattagctgtttattgttttttttttgggggggggaagagaaaaagaaaaaaggag

SEQ ID NO: 14 - protein, 106 aa, Herpes simplex virus
GRVYEEIPWVRVYENICLRRQDAGGAAPPGDAPDSPYIEAENPLYDWGGSALFSPPGATRAPDPGLSLSPMPARPRTNALANDGPTNVAALSALLTKLKRGRHQSH

SEQ ID NO: 15 - protein, 722 aa, Herpes simplex virus
MQRRARGASSLRLARCLTPANLIRGANAGVPERRIFAGCLLPTPEGLLSAAVGVLRQRADDLQPAFLTGADRSVRLAARHHNTVPESLIVDGLASDPHYDYIRHYASAAKQALGEVELSGGQLSRAILAQYWKYLQTVVPSGLDIPDDPAGDCDPSLHVLLRPTLLPKLLVRAPFKSGAAAAKYAAAVAGLRDAAHRLQQYMFFMRPADPSRPSTDTALRLSELLAYVSVLYHWASWMLWTADKYVCRRLGPADRRFVALSGSLEAPAETFARHLDRGPSGTTGSMQCMALRAAVSDVLGHLTRLAHLWETGKRSGGTYGIVDAIVSTVEVLSIVHHHAQYIINATLTGYVVWASDSLNNEYLTAAVDSQERFCRTAAPLFPTMTAPSWARMELSIKSWFGAALAPDLLRSGTPSPHYESILRLAASGPPGGRGAVGGSCRDKIQRTRRDNAPPPLPRARPHSTPAAPRRCRRHREDLPEPPHVDAADRGPEPCAGRPATYYTHMAGAPPRLPPRNPAPPEQRPAAAARPLAAQREAAGVYDAVRTWGPDAEAEPDQMENTYLLPDDDAAMPAGVGLGATPAADTTAAAAWPAESHAPRAPSEDADSIYESVGEDGGRVYEEIPWVRVYENICPRRRLAGGAALPGDAPDSPYIEAENPLYDWGGSALFSPRRATRAPDPGLSLSPMPARPRTNALANDGPTNVAALSALLTKLKRGRHQSH

SEQ ID NO: 16 - DNA, 200 bp, Herpes simplex virus
actgcaacgcaatcccatgaaggccctgtatccgctcaccaccaaggaactcaagacttccgaccccgggggcgtgggcggggagggggaggaaggcgcggaggggggcgggtttgacgaggccaagttggccgaggcccgagaaatgatccgatatatggctttggtgtcggccatggagcgcacggaacacaaggcca

SEQ ID NO: 17 - protein, 66 aa, Herpes simplex virus
LQRNPMKALYPLTTKELKTSDPGGVGGEGEEGAEGGGFDEAKLAEAREMIRYMALVSAMERTEHKA

SEQ ID NO: 18 - protein, 904 aa, Herpes simplex virus
MRGGGLICALVVGALVAAVASAAPAAPAAPRASGGVAATVAANGGPASRPPPVPSPATTKARKRKTKKPPKRPEATPPPDANATVAAGHATLRAHLREIKVENADAQFYVCPPPTGATVVQFEQPRRCPTRPEGQNYTEGIAVVFKENIAPYKFKATMYYKDVTVSQVWFGHRYSQFMGIFEDRAPVPFEEVIDKINTKGVCRSTAKYVRNNMETTAFHRDDHETDMELKPAKVATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATSPTTRNLLTTPKFTVAWDWVPKRPAVCTMTKWQEVDEMLRAEYGGSFRFSSDAISTTFTTNLTEYSLSRVDLGDCIGRDAREAIDRMFARKYNATHIKVGQPQYYLATGGFLIAYQPLLSNTLAELYVREYMREQDRKPRNATPAPLREAPSANASVERIKTTSSIEFARLQFTYNHIQRHVNDMLGRIAVAWCELQNHELTLWNEARKLNPNAIASATVGRRVSARMLGDVMAVSTCVPVAPDNVIVQNSMRVSSRPGTCYSRPLVSFRYEDQGPLIEGQLGENNELRLTRDALEPCTVGHRRYFIFGGGYVYFEEYAYSHQLSRADVTTVSTFIDLNITMLEDHEFVPLEVYTRHEIKDSGLLDYTEVQRRNQLHDLRFADIDTVIRADANAAMFAGLCAFFEGMGDLGRAVGKVVMGVVGGVVSAVSGVSSFMSNPFGALAVGLLVLAGLVAAFFAFRYVLQLQRNPMKALYPLTTKELKTSDPGGVGGEGEEGAEGGGFDEAKLAEAREMIRYMALVSAMERTEHKARKKGTSALLSSKVTNMVLRKRNKARYSPLHNEDEAGDEDEL

SEQ ID NO: 19 - DNA, 443 bp, Herpes simplex virus
ccctctcccacacggtcggtgccccccatctctgtttcatcatcgtcccggttgcgttgcgctttccggccctcccgcacccccgcgttccggtgtctcgcggcccggcgccatgatcacggattgtttcgaagcagacatcgcgatcccctcgggtatctcgcgccccgatgccgcggcgctgcagcggtgcgagggtcgagtggtctttctgccgaccatccgccgccagctggcgctcgcggacgtggcgcacgaatcgttcgtctccggaggagttagtcccgacacgttggggttgttgctggcgtaccgcaggcgcttccccgcggtaatcacgcgggtgctgcccacgcgaatcgtcgcctgccccgtggacctggggctcacgcacgccggcaccgtcaatctccgcaacacctcccccgtcgacctctgcaacg

SEQ ID NO: 20 - protein, 37 aa, Herpes simplex virus
PLPHGRCPPSLFHHRPGCVALSGPPAPPRSGVSRPGA

SEQ ID NO: 21 - protein, 147 aa, Herpes simplex virus
PLPHGRCPPSLFHHRPGCVALSGPPAPPRSGVSRPGAMITDCFEADIAIPSGISRPDAAALQRCEGRVVFLPTIRRQLALADVAHESFVSGGVSPDTLGLLLAYRRRFPAVITRVLPTRIVACPVDLGLTHAGTVNLRNTSPVDLCN

SEQ ID NO: 22 - protein, 110 aa, Herpes simplex virus
MITDCFEADIAIPSGISRPDAAALQRCEGRVVFLPTIRRQLALADVAHESFVSGGVSPDTLGLLLAYRRRFPAVITRVLPTRIVACPVDLGLTHAGTVNLRNTSPVDLCN

SEQ ID NO: 23 - protein, 318 aa, Herpes simplex virus
MITDCFEADIAIPSGISRPDAAALQRCEGRVVFLPTIRRQLALADVAHESFVSGGVSPDTLGLLLAYRRRFPAVITRVLPTRIVACPVDLGLTHAGTVNLRNTSPVDLCNGDPVSLVPPVFEGQATDVRLESLDLTLRFPVPLPTPLAREIVARLVARGIRDLNPDPRTPGELPDLNVLYYNGARLSLVADVQQLASVNTELRSLVLNMVYSITEGTTLILTLIPRLLALSAQDGYVNALLQMQSVTREAAQLIHPEAPMLMQDGERRLPLYEALVAWLAHAGQLGDILALAPAVRVCTFDGAAVVQSGDMAPVIRYP

SEQ ID NO: 24 - DNA, 502 bp, Herpes simplex virus
actgttgtaggggggaaaacacagttccgggaaggcgtttattgcggagagaggggggaaagaaagagaaacaaaagaaacggcaagaaagactcaagacgtgcgcgtgatcggaaaaaaggccggggggatcccggtcggggccgccaggtaaatggccatgatgaccgcgaccatgaggtcgtccgcggcaccgttgcgttttccggagtacatgcggacgtcggtgttgggagagacggtttcgatgaggttgttgagctgctcggacagatactcgaccgggtcggtctgcaggcgcaccgtcacggagacgagctcctgggacgccatgacgcccccggagttgaactttttgataaagtattcgaaggcgggcgtcttctgtttgttgagcagaaagaaggggtacaataccgcgccgccgggcggctcgcagtgatagaagaggagctcgggccccgggccgttggcccccgccgaggccaggatgcggtgcatc

SEQ ID NO: 25 - protein, 135 aa, Herpes simplex virus
MHRILASAGANGPGPELLFYHCEPPGGAVLYPFFLLNKQKTPAFEYFIKKFNSGGVMASQELVSVTVRLQTDPVEYLSEQLNNLIETVSPNTDVRMYSGKRNGAADDLMVAVIMAIYLAAPTGIPPAFFPITRTS

SEQ ID NO: 26 - protein, 734 aa, Herpes simplex virus
MFGQQLASDVQQYLERLEKQRQQKVGVDEASAGLTLGGDALRVPFLDFATATPKRHQTVVPGVGTLHDCCEHSPLFSAVARRLLFNSLVPAQLRGRDFGGDHTAKLEFLAPELVRAVARLRFRECAPEDAVPQRNAYYSVLNTFQALHRSEAFRQLVHFVRDFAQLLKTSFRASSLAETTGPPKKRAKVDVATHGQTYGTLELFQKMILMHATYFLAAVLLGDHAEQVNTFLRLVFEIPLFSDTAVRHFRQRATVFLVPRRHGKTWFLVPLIALSLASFRGIKIGYTAHIRKATEPVFDEIDACLRGWFGSSRVDHVKGETISFSFPDGSRSTIVFASSHNTNGIRGQDFNLLFVDEANFIRPDAVQTIMGFLNQANCKIIFVSSTNTGKASTSFLYNLRGAADELLNVVTYICDDHMPRVVTHTNATACSCYILNKPVFITMDGAVRRTADLFLPDSFMQEIIGGQARETGDDRPVLTKSAGERFLLYRPSTTTNSGLMAPELYVYVDPAFTANTRASGTGIAVVGRYRDDFIIFALEHFFLRALTGSAPADIARCVVHSLAQVLALHPGAFRSVRVAVEGNSSQDSAVAIATHVHTEMHRILASAGANGPGPELLFYHCEPPGGAVLYPFFLLNKQKTPAFEYFIKKFNSGGVMASQELVSVTVRLQTDPVEYLSEQLNNLIETVSPNTDVRMYSGKRNGAADDLMVAVIMAIYLAAPTGIPPAFFPITRTS

SEQ ID NO: 27 - protein, 15 aa, HSV-2
GRVYEEIPWVRVYEN

SEQ ID NO: 28 - protein, 15 aa, HSV-2
YENICLRRQDAGGAA

SEQ ID NO: 29 - protein, 15 aa, HSV-2
PDSPYIEAENPLYDW

SEQ ID NO: 30 - protein, 15 aa, HSV-2
YIEAENPLYDWGGSA

SEQ ID NO: 31 - protein, 15 aa, HSV-2
TNALANDGPTNVAAL

SEQ ID NO: 32 - protein, 15 aa, HSV-2
RVLPTRIVACPVDLG

SEQ ID NO: 33 - protein, 15 aa, HSV-2
TRIVACPVDLGLTHA

SEQ ID NO: 34 - DNA, 661 bp, HSV-2
ctcctcttccgcctcctcctcctcctcttccgcctcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtag

SEQ ID NO: 35 - DNA, 2481 bp, HSV-2
atggaaccccggcccggcacgagctcccgggcggaccccggccccgagcggccgccgcggcagacccccggcacgcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgtgggggtgggcccgtgggtgaggaggaagcggaagcgggaggggggggcgacgtgtgtgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaacccgcggacggccccgcgctccctgtcgctggggggacacacggtccgcgccctgtcgcccacccccccgtggcccggcacggacgacgaggacgatgacctggccgacggtgtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgagacagccccgcgcggcccaggagccccccatagtcatcagcgactctcccccgccgtctccgcgccgccccgcgggccccgggccgctctcctttgtctcctcctcctccgcacaggtgtcctcgggccccggggggggaggtctgccacagtcgtcggggcgcgccgcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccccgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgcctcctcctcctccgcctcctcctcctccgcctcctcctcctccgcctcctcctcctccgcctcctcctcctccgcctcctcctcctccgcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtag

SEQ ID NO: 36 - DNA, 1603 bp, HSV-2
cggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccgcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggttgttgggcaaccacagacgcccggtgttttgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgt

SEQ ID NO: 37 - DNA, 1131 bp, HSV-2
atggcttctcacgccggccaacagcacgcgcctgcgttcggtcaggctgctcgtgcgagcgggcctaccgacggccgcgcggcgtcccgtcctagccatcgccagggggcctccggagcccgcggggatccggagctgcccacgctgctgcgggtttatatagacggaccccacggggtggggaagaccaccacctccgcgcagctgatggaggccctggggccgcgcgacaatatcgtctacgtccccgagccgatgacttactggcaggtgctgggggcctccgagaccctgacgaacatctacaacacgcagcaccgtctggaccgcggcgagatatcggccggggaggcggcggtggtaatgaccagcgcccagataacaatgagcacgccttatgcggcgacggacgccgttttggctcctcatatcgggggggaggctgtgggcccgcaagccccgcccccggccctcacccttgttttcgaccggcaccctatcgcctccctgctgtgctacccggccgcgcggtacctcatgggaagcatgaccccccaggccgtgttggcgttcgtggccctcatgcccccgaccgcgcccggcacgaacctggtcctgggtgtccttccggaggccgaacacgccgaccgcctggccagacgccaacgcccgggcgagcggcttgacctggccatgctgtccgccattcgccgtgtctacgatctactcgccaacacggtgcggtacctgcagcgcggcgggaggtggcgggaggactggggccggctgacgggggtcgccgcggcgaccccgcgccccgaccccgaggacggcgcggggtctctgccccgcatcgaggacacgctgtttgccctgttccgcgttcccgagctgctggcccccaacggggacttgtaccacatttttgcctgggtcttggacgtcttggccgaccgcctccttccgatgcatctatttgtcctggattacgatcagtcgcccgtcgggtgtcgagacgccctgttgcgcctcaccgccgggatgatcccaacccgcgtcacaaccgccgggtccatcgccgagatacgcgacctggcgcgcacgtttgcccgcgaggtggggggagtttag

SEQ ID NO: 38 - DNA, 2517 bp, HSV-2
atgggccccggtctgtgggtggtgatgggggtcctggtgggcgttgccgggggccatgacacgtactggacggagcaaatcgacccgtggtttttgcacggtctggggttggcccgcacgtactggcgcgacacaaacaccgggcgtctgtggttgcccaacacccccgacgccagcgacccccagcgcggacgcttggcgcccccgggcgaactcaacctgactacggcatccgtgcccatgcttcggtggtacgccgagcgcttttgtttcgtgttggtcaccacggccgagtttcctcgggaccccgggcagctgctttacatcccaaagacctatctgctcggccggcctcggaacgcgagcctgcccgagctccccgaggcggggcccacgtcccgtccccccgccgaggtgacccagctcaagggactgtcgcacaaccccggcgcctccgcgctgttgcggtcccgggcctgggtaacattcgcggccgcgccggaccgcgaggggcttacgttcccgcggggagacgacggggcgaccgagaggcacccggacggccgacgcaacgcgccgcccccggggccgcccgcggggacaccgaggcatccgacgacgaacctgagcatcgcgcatctgcacaacgcatccgtgacctggctggccgccaggggcctgctacggactccgggtcggtacgtgtacctctccccgtcggcctcgacgtggcccgtgggcgtctggacgacgggcgggctggcgttcgggtgcgacgccgcgctcgtgcgcgcgcgatacgggaagggcttcatggggctcgtgatatcgatgcgggacagccctccggccgagatcatagtggtgcctgcggacaagaccctcgctcgggtcggaaatccgaccgacgaaaacgcccccgcggtgctccccgggcctccggccggccccaggtatcgcgtctttgtcctgggggccccgacgcccgccgacaacggctcggcgctggacgccctccggcgggtggccggctaccccgaggagagcacgaactacgcccagtatatgtcgcgggcctatgcggagtttttgggggaggacccgggctccggcacggacgcgcgtccgtccctgttctggcgcctcgcggggctgctcgcctcgtcggggtttgcgttcgtcaacgcggcccacgcccacgacgcgattcgcctctccgacctgctgggctttttggcccactcgcgcgtgctggccggcctggccgcccggggagcagcgggctgcgcggccgactcggtgttcctgaacgtgtccgtgttggacccggcggcccgcctgcggctggaggcgcgcctcgggcatctggtggccgcgatcctcgagcgagagcagagcctggtggcgcacgcgctgggctatcagctggcgttcgtgttggacagccccgcggcctatggcgcggtggccccgagcgcggcccgcctgatcgacgccctgtacgccgagtttctcggcggccgcgcgctaaccgccccgatggtccgccgagcgctgttttacgccacggccgtcctccgggcgccgttcctggcgggcgcgccctcggccgagcagcgggaacgcgcccgccggggcctcctcataaccacggccctgtgtacgtccgacgtcgccgcggcgacccacgccgatctccgggccgcgctagccaggaccgaccaccagaaaaacctcttctggctcccggaccacttttccccatgcgcagcttccctgcgcttcgatctcgccgagggcgggttcatcctggacgcgctggccatggccacccgatccgacatcccggcggacgtcatggcacaacagacccgcggcgtggcctccgttctcacgcgctgggcgcactacaacgccctgatccgcgccttcgtcccggaggccacccaccagtgtagcggcccgtcgcacaacgcggagccccggatcctcgtgcccatcacccacaacgccagctacgtcgtcacccacacccccttgccccgcgggatcggatacaagcttacgggcgttgacgtccgccgcccgctgtttatcacctatctcaccgccacctgcgaagggcacgcgcgggagattgagccgaagcggctggtgcgcaccgaaaaccggcgcgacctcggcctcgtgggggccgtgtttctgcgctacaccccggccggggaggtcatgtcggtgctgctggtggacacggatgccacccaacagcagctggcccaggggccggtggcgggcaccccgaacgtgttttccagcgacgtgccgtccgtggccctgttgttgttccccaacggaactgtgattcatctgctggcctttgacacgctgcccatcgccaccatcgcccccgggtttctggccgcgtccgcgctgggggtcgttatgattaccgcggccctggcgggcatccttagggtggtccgaacgtgcgtcccatttttgtggagacgcgaataa

SEQ ID NO: 39 - protein, 376 aa, HSV-2
MASHAGQQHAPAFGQAARASGPTDGRAASRPSHRQGASGARGDPELPTLLRVYIDGPHGVGKTTTSAQLMEALGPRDNIVYVPEPMTYWQVLGASETLTNIYNTQHRLDRGEISAGEAAVVMTSAQITMSTPYAATDAVLAPHIGGEAVGPQAPPPALTLVFDRHPIASLLCYPAARYLMGSMTPQAVLAFVALMPPTAPGTNLVLGVLPEAEHADRLARRQRPGERLDLAMLSAIRRVYDLLANTVRYLQRGGRWREDWGRLTGVAAATPRPDPEDGAGSLPRIEDTLFALFRVPELLAPNGDLYHIFAWVLDVLADRLLPMHLFVLDYDQSPVGCRDALLRLTAGMIPTRVTTAGSIAEIRDLARTFAREVGGV

SEQ ID NO: 40 - protein, 136 aa, HSV-2
DLLANTVRYLQRGGRWREDWGRLTGVAAATPRPDPEDGAGSLPRIEDTLFALFRVPELLAPNGDLYHIFAWVLDVLADRLLPMHLFVLDYDQSPVGCRDALLRLTAGMIPTRVTTAGSIAEIRDLARTFAREVGGV

SEQ ID NO: 41 - protein, 284 aa, HSV-2
MGPGLWVVMGVLVGVAGGHDTYWTEQIDPWFLHGLGLARTYWRDTNTGRLWLPNTPDASDPQRGRLAPPGELNLTTASVPMLRWYAERFCFVLVTTAEFPRDPGQLLYIPKTYLLGRPRNASLPELPEAGPTSRPPAEVTQLKGLSHNPGASALLRSRAWVTFAAAPDREGLTFPRGDDGATERHPDGRRNAPPPGPPAGTPRHPTTNLSIAHLHNASVTWLAARGLLRTPGRYVYLSPSASTWPVGVWTTGGLAFGCDAALVRARYGKGFMGLVISMRDSPPA

SEQ ID NO: 42 - protein, 15 aa, HSV-2
SLPRIEDTLFALFRV

SEQ ID NO: 43 - protein, 15 aa, HSV-2
GSIAEIRDLARTFAR

SEQ ID NO: 44 - protein, 16 aa, HSV-2
EIRDLARTFAREVGGV

SEQ ID NO: 45 - protein, 838 aa, HSV-2
MGPGLWVVMGVLVGVAGGHDTYWTEQIDPWFLHGLGLARTYWRDTNTGRLWLPNTPDASDPQRGRLAPPGELNLTTASVPMLRWYAERFCFVLVTTAEFPRDPGQLLYIPKTYLLGRPRNASLPELPEAGPTSRPPAEVTQLKGLSHNPGASALLRSRAWVTFAAAPDREGLTFPRGDDGATERHPDGRRNAPPPGPPAGTPRHPTTNLSIAHLHNASVTWLAARGLLRTPGRYVYLSPSASTWPVGVWTTGGLAFGCDAALVRARYGKGFMGLVISMRDSPPAEIIVVPADKTLARVGNPTDENAPAVLPGPPAGPRYRVFVLGAPTPADNGSALDALRRVAGYPEESTNYAQYMSRAYAEFLGEDPGSGTDARPSLFWRLAGLLASSGFAFVNAAHAHDAIRLSDLLGFLAHSRVLAGLAARGAAGCAADSVFLNVSVLDPAARLRLEARLGHLVAAILEREQSLVAHALGYQLAFVLDSPAAYGAVAPSAARLIDALYAEFLGGRALTAPMVRRALFYATAVLRAPFLAGAPSAEQRERARRGLLITTALCTSDVAAATHADLRAALARTDHQKNLFWLPDHFSPCAASLRFDLAEGGFILDALAMATRSDIPADVMAQQTRGVASVLTRWAHYNALIRAFVPEATHQCSGPSHNAEPRILVPITHNASYVVTHTPLPRGIGYKLTGVDVRRPLFITYLTATCEGHAREIEPKRLVRTENRRDLGLVGAVFLRYTPAGEVMSVLLVDTDATQQQLAQGPVAGTPNVFSSDVPSVALLLFPNGTVIHLLAFDTLPIATIAPGFLAASALGVVMITAALAGILRVVRTCVPFLWRRE

SEQ ID NO: 46 - protein, 215 aa, HSV-2
SSSASSSSASSSSASSSAGGAGGSVASASGAGERRETSLGPRAAAPRGPRKCARKTRHAEGGPEPGARDPAPGLTRYLPIAGVSSVVALAPYVNKTVTGDCLPVLDMETGHIGAYVVLVDQTGNVADLLRAAAPAWSRRTLLPEHARNCVRPPDYPTPPASEWNSLWMTPVGNMLFDQGTLVGALDFHGLRSRHPWSREQGAPAPAGDAPAGHGE

SEQ ID NO: 47 - protein, 826 aa, HSV-2
MEPRPGTSSRADPGPERPPRQTPGTQPAAPHAWGMLNDMQWLASSDSEEETEVGISDDDLHRDSTSEAGSTDTEMFEAGLMDAATPPARPPAERQGSPTPADAQGSCGGGPVGEEEAEAGGGGDVCAVCTDEIAPPLRCQSFPCLHPFCIPCMKTWIPLRNTCPLCNTPVAYLIVGVTASGSFSTIPIVNDPRTRVEAEAAVRAGTAVDFIWTGNPRTAPRSLSLGGHTVRALSPTPPWPGTDDEDDDLADGVDYVPPAPRRAPRRGGGGAGATRGTSQPAATRPAPPGAPRSSSSGGAPLRAGVGSGSGGGPAVAAVVPRVASLPPAAGGGRAQARRVGEDAAAAEGRTPPARQPRAAQEPPIVISDSPPPSPRRPAGPGPLSFVSSSSAQVSSGPGGGGLPQSSGRAARPRAAVAPRVRSPPRAAAAPVVSASADAAGPAPPAVPVDAHRAPRSRMTQAQTDTQAQSLGRAGATDARGSGGPGAEGGPGVPRGTNTPGAAPHAAEGAAARPRKRRGSDSGPAASSSASSSAAPRSPLAPQGVGAKRAAPRRAPDSDSGDRGHGPLAPASAGAAPPSASPSSQAAVAAASSSSASSSSASSSSASSSSASSSSASSSSASSSSASSSAGGAGGSVASASGAGERRETSLGPRAAAPRGPRKCARKTRHAEGGPEPGARDPAPGLTRYLPIAGVSSVVALAPYVNKTVTGDCLPVLDMETGHIGAYVVLVDQTGNVADLLRAAAPAWSRRTLLPEHARNCVRPPDYPTPPASEWNSLWMTPVGNMLFDQGTLVGALDFHGLRSRHPWSREQGAPAPAGDAPAGHGE

SEQ ID NO: 48 - DNA, 3350 bp, HSV-2
  misc_feature 1027, 1034, 1054, 1055, 1056, 1057, 1058, 1059, 1060, 1061,1062, 1063, 1064, 1065, 1066, 1067, 1068, 1069, 1070, 1071,1072, 1073, 1074, 1075, 1076, 1077, 1078, 1079, 1080, 1081,1082, 1083, 1084, 1085, 1086, 1087, 1088, 1089, 1090: n = A,T,C or G
  misc_feature 1091, 1092, 1093, 1094, 1095, 1096, 1097, 1098, 1099, 1100,1101, 1102, 1103, 1104, 1105, 1106, 1107, 1108, 1109, 1110,1111, 1112, 1113, 1114, 1115, 1116, 1117, 1118, 1119, 1120,1121, 1122, 1123, 1124, 1125, 1126, 1127, 1128, 1129: n = A,T,C or G
  misc_feature 1130, 1131, 1132, 1133, 1134, 1135, 1136, 1137, 1138, 1139,1140, 1141, 1142, 1143, 1144, 1145, 1146, 1147, 1148, 1149,1150, 1151, 1152, 1327, 1364, 1390, 1392: n = A,T,C or G
ccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgcgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgaagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcgngccatcntgcatcgtgggcccgacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggncaggtgaaccgagggggcgtggctaggcggcccgacngggagcatcgcggacagcggcgtggncngggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgtgtgggggg

SEQ ID NO: 49 - DNA, 3345 bp, HSV-2
atgtcggacagcgcgctccaggtcccggcgcccgccggcatgacccccccgtccgctccacccccaaacggaccgttgcaggtcctgttggggagcctgaccaacctccgccggccgccctccccctcgagcgagccggcgggcagcgcggacgagccggcgtttctgtccgcggccaaactgcacgccgccacggcggcgtttctgttgtcgggcgcggcggtcggcccggcggaggcgcgggcgtgctggcacccgctcctggagcaactgtgcgccttgcaccgggcccacgggcttccggagacggcgctcttggccgagaacctccccgggctgctggtgcaccgcatggcggtggcgctccccgagacccccgaggcggccttccgggagatggacgtcatcaaggacacggtcctggcgatcaccggctccgacacgacccacgcgctggaggccgccgggctgcgcaccacggcggccctggggccggtgcgcgtccgccagtgtgccgtggagtggatcgaccgctggcggaccgtcacccagagctgcctggccatgaacccgcggacctccctggaggccctcggggagatgtcgcttaagatgtccccggttcccctggggcaacccggcgccaacctgaccaccccggcgtacagcctgctcttcccgtccccgatcgtgcaagagggtctccggttcttggccctggtcagcaattgggtgacgctgttctcggcgcacctacagcgcatcgacgacgccgccctgacccccctcacgcgggccctgtttacgctggcgctggtggacgactacctgacgacccccgatcggggcgcggtggtcccgccgccgctgctggcccagtttcagcacacggtgcgggagatcgacccggctatcatgatcccgcccctcgaggccaccaaaatggttcgcagtcgcgaggaggtgcgcgtgtcgaccgccctaagccgcgtcagcccgcggtcggcgtgcgcgcccccggggacgctgatggcgcgcgtgcggacggacgcggccgtcttcgaccccgacgtgccgtttctgagtgcgtcggcgctggccatcttccgtccggccgtcaccggcctgctgcagctaggggagccgccctccgccggggcccagcaacggctcctcgcgctgctgcagcagacgtgggctttggtccagaacagcaactcgccctccgtggtgatcaacacgcttaccgacgcggggttcacgcccgcgcactgcacccagtacatatcggccctggaggggtttttggtggcgggggtgcccgcgcggacgccccccggccacgggctcagcgagatccagcagctctttgggtgcattgcccttgcgggggcgaacgtgttcgggctcgcgcgggagtacgggcactacgccggctacgtgaaaacgttccggcggatccagggcgccagcgagcacacgcacgggcggctctgtgaggcggtcggcctgtcgggcggcgtcctcagccagacgctggcgcgcatcatgggcccggccgtgccgacggaacacctggcgagcctgcggcgcacgctcgtgggggagtttgagacggccgagcgccgcttcagcgccggccagcccagcctcctgcgcgagacggcgctcatctggctcgacgtgtacggccagacccactgggacctgacccccaccaccccggccacgccgctgtccgcgctgctccccgtcgggccgcctagccacgccccctcggttcacctggccgcggccaccaagatccgcttcccggccctggagggcatccaccccaacgtcctcgccgacccggggttcgtcccttacgtgctggccctggtggtcggggacgcgctgagggccacgtgcaacgctgcctacctgccccgccccatcgagtttgccctgcgggtgctggcctgggcgcgcgacttcggcctgggctatctccccaccgtcgaggggcaccgcacaaaattgggcgcgctgatcaccctcctcgaaccggccacccgggccggcgtcgggcccacgatgcagatggccgacaacatcgagcagctgctgcgcgagctgtacgtgatcgccaggggggccgtcgagcagctgcggcccgcggtccagctgcctcccccccagcctcccgaggtgggcagcagcctgctgctgatcagcatgtacgccctggcggcccggggggtgctgcaggagctcgccgagcgcgccgaccccctggtccgccagctggaggacgcgatcgtgctgctgcggctgcacatgcgcacgctcgccgccttctttgagtgccggttcgagagcgacgggcaccgcctgtacgccgtggtcgcagacgcccacgagcgcctggggccctggcgccccgaggccatgggcgacgcggtgagccagtactgcggcatgtatcacgacgccaagcgcgcgctggtcgcgtccctcgcggggctgcggtccgtcgtcaccgagacgacggcgcacctcggggtatgcgacgagctggcggcccaggtctcgcacgagggtaacgtgctggccgtcgtgcggcgggaaatccacgggttcctggccatcgtgtcgggcatccacgccagggcgtcaaagttgatgtcgggggaccaggtccccgggttctgttacatgagtcagttcctggcgcgctggcggcgcctctcggccggctatcaggccgcacgcgcggccacgggccccgagcgggtggccgagttcgttcaggaactccacgacacgtggaagggcctgcagacggagcgcgcgctggtcgtggcgcgcttcgccagctcggccgatcagcgcaccgcagccattcaggaggtgatggcccacgcgaccgaggacgcgccccccagcccggccgcagacctcgtcgtgctcacgaaccgtcatgacctgggggcctggggggactacagcctggggcccctgggtcagccgacggtggttccggactccgtggacctgtctccccaggggctggccgctacgctgagcatggactggctattaataaacgagctcctgcaggtcaccgacggcgtgtttcgcgcctcggcgtttcggccttccgccggcccgggggcccccggggacctggaggcccaagatgccggcggtagcacccccgaacccacgacacccggcccacaggacacgcaggcccgcgcgccgtcgacgcgcccggcgggccgcgagacggtcccttggcccaacacccccgtggaggacgacgagatgacgccgcaggagacaccaccggtacacccgtag

SEQ ID NO: 50 - protein, 993 aa, HSV-2
EPAGSADEPAFLSAAKLHAATAAFLLSGAAVGPAEARACWHPLLEQLCALHRAHGLPETALLAENLPGLLVHRMAVALPETPEAAFREMDVIKDTVLAITGSDTTHALEAAGLRTTAALGPVRVRQCAVEWIDRWRTVTQSCLAMNPRTSLEALGEMSLKMSPVPLGQPGANLTTPAYSLLFPSPIVQEGLRFLALVSNWVTLFSAHLQRIDDAALTPLTRALFTLALVDDYLTTPDRGAVVPPPLLAQFQHTVREIDPAIMIPPLEATKMVRSREEVRVSTALSRVSPRSACAPPGTLMARVRTDAAVFDPDVPFLSASALAIFRPAVTGLLQLGEPPSAGAQQRLLALLQQTWALVQNSNSPSVVINTLTDAGFTPAHCTQYISALEGFLVAGVPARTPPGHGLSEIQQLFGCIALAGANVFGLAREYGHYAGYVKTFRRIQGASEHTHGRLCEAVGLSGGVLSQTLARIMGPAVPTEHLASLRRTLVGEFETAERRFSAGQPSLLRETALIWLDVYGQTHWDLTPTTPATPLSALLPVGPPSHAPSVHLAAATKIRFPALEGIHPNVLADPGFVPYVLALVVGDALRATCNAAYLPRPIEFALRVLAWARDFGLGYLPTVEGHRTKLGALITLLEPATRAGVGPTMQMADNIEQLLRELYVIARGAVEQLRPAVQLPPPQPPEVGSSLLLISMYALAARGVLQELAERADPLVRQLEDAIVLLRLHMRTLAAFFECRFESDGHRLYAVVADAHERLGPWRPEAMGDAVSQYCGMYHDAKRALVASLAGLRSVVTETTAHLGVCDELAAQVSHEGNVLAVVRREIHGFLAIVSGIHARASKLMSGDQVPGFCYMSQFLARWRRLSAGYQAARAATGPERVAEFVQELHDTWKGLQTERALVVARFASSADQRTAAIQEVMAHATEDAPPSPAADLVVLTNRHDLGAWGDYSLGPLGQPTVVPDSVDLSPQGLAATLSMDWLLINELLQVTD

SEQ ID NO: 51 - protein, 1113 aa, HSV-2
MSDSALQVPAPAGMTPPSAPPPNGPLQVLLGSLTNLRRPPSPSSEPAGSADEPAFLSAAKLHAATAAFLLSGAAVGPAEARACWHPLLEQLCALHRAHGLPETALLAENLPGLLVHRMAVALPETPEAAFREMDVIKDTVLAITGSDTTHALEAAGLRTTAALGPVRVRQCAVEWIDRWRTVTQSCLAMNPRTSLEALGEMSLKMSPVPLGQPGANLTTPAYSLLFPSPIVQEGLRFLALVSNWVTLFSAHLQRIDDAALTPLTRALFTLALVDDYLTTPDRGAVVPPPLLAQFQHTVREIDPAIMIPPLEATKMVRSREEVRVSTALSRVSPRSACAPPGTLMARVRTDAAVFDPDVPFLSASALAIFRPAVTGLLQLGEPPSAGAQQRLLALLQQTWALVQNSNSPSVVINTLTDAGFTPAHCTQYISALEGFLVAGVPARTPPGHGLSEIQQLFGCIALAGANVFGLAREYGHYAGYVKTFRRIQGASEHTHGRLCEAVGLSGGVLSQTLARIMGPAVPTEHLASLRRTLVGEFETAERRFSAGQPSLLRETALIWLDVYGQTHWDLTPTTPATPLSALLPVGPPSHAPSVHLAAATKIRFPALEGIHPNVLADPGFVPYVLALVVGDALRATCNAAYLPRPIEFALRVLAWARDFGLGYLPTVEGHRTKLGALITLLEPATRAGVGPTMQMADNIEQLLRELYVIARGAVEQLRPAVQLPPPQPPEVGSSLLLISMYALAARGVLQELAERADPLVRQLEDAIVLLRLHMRTLAAFFECRFESDGHRLYAVVADAHERLGPWRPEAMGDAVSQYCGMYHDAKRALVASLAGLRSVVTETTAHLGVCDELAAQVSHEGNVLAVVRREIHGFLAIVSGIHARASKLMSGDQVPGFCYMSQFLARWRRLSAGYQAARAATGPERVAEFVQELHDTWKGLQTERALVVARFASSADQRTAAIQEVMAHATEDAPPSPAADLVVLTNRHDLGAWGDYSLGPLGQPTVVPDSVDLSPQGLAATLSMDWLLINELLQVTDGVFRASAFRPSAGPGAPGDLEAQDAGGSTPEPTTPGPQDTQARAPSTPAGRETVPWPNTPVEDDEMTPQETPPVHP

SEQ ID NO: 52 - DNA, 3113 bp, HSV-2
atgtcggacagcgcgctccaggtcccggcgcccgccggcatgacccccccgtccgctccacccccaaacggaccgttgcaggtcctgttggggagcctgaccaacctccgccggccgccctccccctcgagcgagccggcgggcagcgcggacgagccggcgtttctgtccgcggccaaactgcgcgccgccacggcggcgtttctgttgtcgggcgcggcggtcggcccggcggaggcgcgggcgtgctggcacccgctcctggagcaactgtgcgccttgcaccgggcccacgggcttccggagacggcgctcttggccgagaacctccccgggctgctggtgcaccgcatggcggtggcgctccccgagacccccgaggcggccttccgggagatggacgtcatcaaggacacggtcctggcgatcaccggctccgacacgacccacgcgctggaggccgccgggctgcgcaccacggcggccctggggccggtgcgcgtccgccagtgtgccgtggagtggatcgaccgctggcggaccgtcacccagagctgcctggccatgaacccgcggacctccctggaggccctcggggagatgtcgcttaagatgtccccggttcccctggggcaacccggcgccaacctgaccaccccggcgtacagcctgctcttcccgtccccgatcgtgcaagagggtctccggttcttggccctggtcagcaattgggtgacgctgttctcggcgcacctacagcgcatcgacgacgccgccctgacccccctcacgcgggccctgtttacgctggcgctggtggacgagtacctgacgacccccgatcggggcgcggtggtcccgccgccgctgctggcccagtttcagcacacggtgcgggagatcgacccggctatcatgatcccgcccctcgaggccaccaaaatggttcgcagtcgcgaggaggtgcgcgtgtcgaccgccctaagccgcgtcagcccgcggtcggcgtgcgcgcccccggggacgctgatggcgcgcgtgcggacggacgcggccgtcttcgaccccgacgtgccgtttctgagtgcgtcggcgctggccatcttccgtccggccgtcaccggcctgctgcagctaggggagccgccctccgccggggcccagcaacggctcctcgcgctgctgcagcagacgtgggctttggtccagaacagcaactcgccctccgtggtgatcaacacgcttaccgacgcggggttcacgcccgcgcactgcacccagtacatatcggccctggaggggtttttggtggcgggggtgcccgcgcggacgccccccggccacgggctcagcgagatccagcagctctttgggtgcattgcccttgcgggggcgaacgtgttcgggctcgcgcgggagtacgggcactacgccggctacgtgaaaacgttccggcggatccagggcgccagcgagcacacgcacgggcggctctgtgaggcggtcggcctgtcgggcggcgtcctcagccagacgctggcgcgcatcatgggcccggccgtgccgacggaacacctggcgagcctgcggcgcacgctcgtgggggagtttgagacggccgagcgccgcttcagcgccggccagcccagcctcctgcgcgagacggcgctcatctggctcgacgtgtacggccagacccactgggacctgacccccaccaccccggccacgccgctgtccgcgctgctccccgtcgggccgcctagccacgccccctcggttcacctggccgcggccaccaagatccgcttcccggccctggagggcatccaccccaacgtcctcgccgacccggggttcgtcccttacgtgctggccctggtggtcggggacgcgctgagggccacgtgcaacgctgcctacctgccccgccccatcgagtttgccctgcgggtgctggcctgggcgcgcgacttcggcctgggctatctccccaccgtcgaggggcaccgcacaaaattgggcgcgctgatcaccctcctcgaaccggccacccgggccggcgtcgggcccacgatgcagatggccgacaacatcgagcagctgctgcgcgagctgtacgtgatcgccaggggggccgtcgagcagctgcggcccgcggtccagctgcctcccccccagcctcccgaggtgggcagcagcctgctgctgatcagcatgtacgccctggcggcccggggggtgctgcaggagctcgccgagcgcgccgaccccctggtccgccagctggaggacgcgatcgtgctgctgcggcttcacatgcgcacgctcgccgccttctttgagtgccggttcgagagcgacgggcaccgcctgtacgccgtggtcgcagacgcccacgagcgcctggggccctggcgccccgaggccatgggcgacgcggtgagccagtactgcggcatgtatcacgacgccaagcgcgcgctggtcgcgtccctcgcggggctgcggtccgtcgtcaccgagacgacggcgcacctcggggtatgcgacgagctggcggcccaggtctcgcacgagggtaacgtgctggccgtcgtgcggcgggaaatccacgggttcctggccatcgtgtcgggcatccacgccagggcgtcaaagttgatgtcgggggaccaggtccccgggttctgttacatgagtcagttcctggcgcgctggcggcgcctctcggccggctatcaggccgcgcgcgcggccacgggccccgagcgggtggccgagttcgttcaggaactccacgacacgtggaagggcctgcagacggagcgcgcgctggtcgtggcgcccttcgccagctcggccgatcagcgcaccgcagccattcaggaggtgatggcccacgcgaccgaggacgcgccccccagcccggccgcagacctcgtcgtgctcacgaaccgtcatgacctgggggcctggggggactacagcctggggcccctgggtcagccgacggtggttccggactccgtggacctgtctccccaggggctggccgctacgctgagcatggactggctattaataaacgagctcctgcaggtcaccgacgg

SEQ ID NO: 53 - DNA, 761 bp, HSV-2
gcgcccgctcgcggctcagcgcgaggccgccggggtttacgacgcggtgcggacctgggggccagacgcggaggccgaaccggaccagatggaaaacacgtatctgctgcccgacgatgacgccgccatgcccgcgggcgtcgggcttggcgccacccccgccgccgacaccaccgccgccgcctggccggccgaaagccacgccccccgcgccccctccgaggacgcagattccatttacgagtcggtgagcgaggatggggggcgcgtctacgaggagatcccytgggttcgggtatacgaaaacatctgccttcgccggcaagacgccggcggggcggccccgccgggagacgccccggactccccgtacatcgaggcggaaaatcccctgtacgactggggcgggtctgccctcttctcccctccgggggccacacgcgccccggacccgggactaagcctgtcgcccatgcccgcccgcccccggaccaacgcgctggccaacgacggcccgacaaacgtcgccgccctcagcgccctgttgacgaagctcaaacgcggccgacaccagagccattaaaaaaatgcgaccgccggccccaccgtctcggtttccggcccctttccccgtatgtctgttttcaataaaaagtaacaaacagagaaaaaaaaacagcgagttccgcatggtttgtcgtacgcaattagctgtttattgttttttttttgggggggggaagagaaaaagaaaaaaggag

SEQ ID NO: 54 - protein, 1037 aa, HSV-2
MSDSALQVPAPAGMTPPSAPPPNGPLQVLLGSLTNLRRPPSPSSEPAGSADEPAFLSAAKLRAATAAFLLSGAAVGPAEARACWHPLLEQLCALHRAHGLPETALLAENLPGLLVHRMAVALPETPEAAFREMDVIKDTVLAITGSDTTHALEAAGLRTTAALGPVRVRQCAVEWIDRWRTVTQSCLAMNPRTSLEALGEMSLKMSPVPLGQPGANLTTPAYSLLFPSPIVQEGLRFLALVSNWVTLFSAHLQRIDDAALTPLTRALFTLALVDEYLTTPDRGAVVPPPLLAQFQHTVREIDPAIMIPPLEATKMVRSREEVRVSTALSRVSPRSACAPPGTLMARVRTDAAVFDPDVPFLSASALAIFRPAVTGLLQLGEPPSAGAQQRLLALLQQTWALVQNSNSPSVVINTLTDAGFTPAHCTQYISALEGFLVAGVPARTPPGHGLSEIQQLFGCIALAGANVFGLAREYGHYAGYVKTFRRIQGASEHTHGRLCEAVGLSGGVLSQTLARIMGPAVPTEHLASLRRTLVGEFETAERRFSAGQPSLLRETALIWLDVYGQTHWDLTPTTPATPLSALLPVGPPSHAPSVHLAAATKIRFPALEGIHPNVLADPGFVPYVLALVVGDALRATCNAAYLPRPIEFALRVLAWARDFGLGYLPTVEGHRTKLGALITLLEPATRAGVGPTMQMADNIEQLLRELYVIARGAVEQLRPAVQLPPPQPPEVGSSLLLISMYALAARGVLQELAERADPLVRQLEDAIVLLRLHMRTLAAFFECRFESDGHRLYAVVADAHERLGPWRPEAMGDAVSQYCGMYHDAKRALVASLAGLRSVVTETTAHLGVCDELAAQVSHEGNVLAVVRREIHGFLAIVSGIHARASKLMSGDQVPGFCYMSQFLARWRRLSAGYQAARAATGPERVAEFVQELHDTWKGLQTERALVVAPFASSADQRTAAIQEVMAHATEDAPPSPAADLVVLTNRHDLGAWGDYSLGPLGQPTVVPDSVDLSPQGLAATLSMDWLLINELLQVTD

SEQ ID NO: 55 - protein, 193 aa, HSV-2
RPLAAQREAAGVYDAVRTWGPDAEAEPDQMENTYLLPDDDAAMPAGVGLGATPAADTTAAAWPAESHAPRAPSEDADSIYESVSEDGGRVYEEIPWVRVYENICLRRQDAGGAAPPGDAPDSPYIEAENPLYDWGGSALFSPPGATRAPDPGLSLSPMPARPRTNALANDGPTNVAALSALLTKLKRGRHQSH

SEQ ID NO: 56 - protein, 15 aa, HSV-2
SPNTDVRMYSGKRNG

SEQ ID NO: 57 - protein, 15 aa, HSV-2
YLAAPTGIPPAFFPI

SEQ ID NO: 58 - protein, 15 aa, HSV-2
GVAAATPRPDPEDGA

SEQ ID NO: 59 - protein, 15 aa, HSV-2
EEIPWVRVYENICPR

SEQ ID NO: 60 - protein, 15 aa, HSV-2
PGDAPDSPYIEAENP

SEQ ID NO: 61 - protein, 15 aa, HSV-2
PDSPYIEAENPLYDW

SEQ ID NO: 62 - protein, 15 aa, HSV-2
ENPLYDWGGSALFSP

SEQ ID NO: 63 - protein, 15 aa, HSV-2
AIDYVHCEGIIHRDI

SEQ ID NO: 64 - protein, 15 aa, HSV-2
AFPVALHAVDAPSQF

SEQ ID NO: 65 - DNA, 3429 bp, HSV-2
atggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctcaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaa

SEQ ID NO: 66 - DNA, 825 bp, HSV-2
ggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggctcgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactg

SEQ ID NO: 67 - DNA, 678 bp, HSV-2
atggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggctcgggttcggagacgctgtctcgatcctcttcgatctgggccgcaggggcgactgacgacgat

SEQ ID NO: 68 - DNA, 313 bp, HSV-2
gacgaggggtcggaatccaaaggacgcagaccacctttggttacggacccctttctcccccccttccgaacaaaaagcagcgggcggggggccggggtgagggagggacacgggggacacggcacgggggtcccgcctcacgccccgcgccctctaaatcccccccgtttctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggca

SEQ ID NO: 69 - DNA, 467 bp, HSV-2
  misc_feature 39,322,332,368,369: n = A,T,C or G
cagggcagccccacgcccgccgacgcgcagggatcctgntgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggcngtgcgggtcnggcacggccgtggactttatctggacgggcaacccnnggacggccccgcgctccctgtcgctggggggacacacggtccgcgccctgtcgcccacccccccgtggcccggcacggacgacgaggacgatgacctc

SEQ ID NO: 70 - DNA, 204 bp, HSV-2
  misc_feature 78,79,120,121,124,125: n = A,T,C or G
gcccctattggtcccctgggcttcctagtatgctaatgaatttctccccgggggcgggcaccactcagggccgcgcgnngggccgcgggggactcccatctgcgtcggcggggggcggcnnatnntaatggggttcttggagtacacccggttggtccccggggacggcccgccccgagagggggattccctccctccgccccc

SEQ ID NO: 71 - DNA, 474 bp, HSV-2
  misc_feature 7,43,56,339,424,431,451,468,474: n = A,T,C or G
ccccggnccgcttaagcggtcgggggacccccgtgggccgtgngccgccccccgancctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcacgggggtcccgcctcacgccccgcgccctctaaatcccccccgtttctttgtcaagcagcccgccgccccgcacgcctgggggatgctcaacgacatgcagtngctcgccagcagcgactcggaggaggagaccgaggtgggaatctctgacgacgaccttcaccgcgactccacctccgaggcgggncagcacnggacacggagatgttcgagncgggcctgatggacgcngccacn

SEQ ID NO: 72 - DNA, 350 bp, HSV-2
  misc_feature 107,148,185,187,305,312,313: n = A,T,C or G
ggggtcggaatccaaaggacgcagaccacctttggttacggacccctttctcccccccttccgaacaaaaagcagcgggcggggggccggggtgagggagggacacngggggacacggcacgggggtcccgcctcacgccccgcgccntctaaatcccccccgtttctttgtcaagcagcccgcngncccgcacgcctgggggatgctcaacgacatgcagtggctcgccagcagcgactcggaggaggagaccgaggtgggaatctctgacgacgaccttcaccgcgactccacctccgaggcngggcagnncggacacggagatgttcgaggcgggcttgatggacgc

SEQ ID NO: 73 - DNA, 312 bp, HSV-2
  misc_feature 21,32,39,66,306: n = A,T,C or G
gccccacgcccgccgacgcgnagggatcctgngggggtnggcccgtgggtgaggaggaagcggaancgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccngaggcg

SEQ ID NO: 74 - protein, 274 aa, HSV-2
KVSGVMVLSSDPPGPAAYRISDSSFVQCGSNCSMIIDGDVARGHLRDLEGATSTGAFVAISNVAAGGDGRTAVVALGGTSGPSATTSVGTQTSGEFLHGNPRTPEPQGPQAVPPPPPPPFPWGHECCARRDARGGAEKDVGAAESWSDGPSSDSETEDSDSSDEDTGSGSETLSRSSSIWAAGATDDDDSDSDSRSDDSVQPDVVVRRRWSDGPAPVAFPKPRRPGDSPGNPGLGAGTGPGSATDPRASADSDSAAHAAAPQADVAPVLDSQPT

SEQ ID NO: 75 - protein, 226 aa, HSV-2
MANRPAASALAGARSPSERQEPREPEVAPPGGDHVFCRKVSGVMVLSSDPPGPAAYRISDSSFVQCGSNCSMIIDGDVARGHLRDLEGATSTGAFVAISNVAAGGDGRTAVVALGGTSGPSATTSVGTQTSGEFLHGNPRTPEPQGPQAVPPPPPPPFPWGHECCARRDARGGAEKDVGAAESWSDGPSSDSETEDSDSSDEDTGSGSETLSRSSSIWAAGATDDD

SEQ ID NO: 76 - DNA, 4125 bp, HSV-2
atggccgctcctgcccgcgaccccccgggttaccggtacgccgcggccatcctgcccaccggctccatcctgagtacgatcgaggtggcgtcccaccgcagactctttgattttttcgccgccgtgcgctccgacgaaaacagcctgtatgacgtagagtttgacgccctgctggggtcctactgcaacaccctgtcgctcgtgcgctttctggagctcggcctgtccgtggcgtgcgtgtgcaccaagttcccggagctggcttacatgaacgaagggcgtgtgcagttcgaggtccaccagcccctcatcgcccgcgacggcccgcaccccgtcgagcagcccgtgcataattacatgacgaaggtcatcgaccgccgggccctgaacgccgccttcagcctggccaccgaggccattgccctgctcacgggggaggccctggacgggacgggcattagcctgcatcgccagctgcgcgccatccagcagctcgcgcgcaacgtccaggccgtcctgggggcgtttgagcgcggcacggccgaccagatgctgcacgtgctgttggagaaggcgcctcccctggccctgctgttgcccatgcaacgatatctcgacaacgggcgcctggcgaccagggttgcccgggcgaccctggtcgccgagctgaagcggagcttttgcgacacgagcttcttcctgggcaaggcgggccatcgccgcgaggccatcgaggcctggctcgtggacctgaccacggcgacgcagccgtccgtggccgtgccccgcctgacgcacgccgacacgcgcgggcggccggtcgacggggtgctggtcaccaccgccgccatcaaacagcgcctcctgcagtccttcctgaaggtggaggacaccgaggccgacgtgccggtgacctacggcgagatggtcttgaacggggccaacctcgtcacggcgctggtgatgggcaaggccgtgcggagcctggacgacgtgggccgccacctgctggatatgcaggaggagcaactcgaggcgaaccgggagacgctggatgaactcgaaagcgccccccagacaacgcgcgtgcgcgcggatctggtggccataggcgacaggctggtcttcctggaggccctggagagacgcatctacgccgccaccaacgtgccctaccccctggtgggcgccatggacctgacgttcgtcctgcccctggggctgttcaacccggccatggagcgcttcgccgcgcacgccggggacctggtgcccgcccccggccacccggagccccgcgcgttccctccccggcagctgtttttttggggaaaggaccaccaggttctgcggctgtccatggagaacgcggtcgggaccgtgtgtcatccttcgctcatgaacatcgacgcggccgtcgggggcgtgaaccacgaccccgtcgaggccgcgaatccgtacggggcgtacgtcgcggccccggccggccccggcgcggacatgcagcagcgttttctgaacgcctggcggcagcgcctcgcccacggccgggtccggtgggtcgccgagtgccagatgaccgcggagcagttcatgcagcccgacaacgccaacctggctctggagctgcaccccgcgttcgacttcttcgcgggcgtggccgacgtcgagcttcccggcggcgaagtccccccggccggtccgggggcgatccaggccacctggcgcgtggtcaacggcaacctgcccctggcgctgtgtccggtggcgtttcgtgacgcccggggcctggagctcggcgttggccgccacgccatggcgccggctaccatagccgccgtccgcggggcgttcgaggaccgcagctacccggcggtgttttacctgctgcaagccgcgattcacggcaacgagcacgtgttctgcgccctggcgcggctcgtgactcagtgcatcaccagctactggaacaacacgcgatgcgcggcgttcgtgaacgactactcgctggtctcgtacatcgtgacctacctcgggggcgacctccccgaggagtgcatggccgtgtatcgggacctggtggcccacgtcgaggccctggcccagctggtggacgactttaccctgccgggcccggagctgggcgggcaggctcaggccgagctgaatcacctgatgcgcgacccggcgctgctgccgcccctcgtgtgggactgcgacggccttatgcgacacgcggccctggaccgccaccgagactgccggattgacgcgggggggcacgagcccgtctacgcggcggcgtgcaacgtggcgacggccgactttaaccgcaacgacggccggctgctgcacaacacccaggcccgcgcggccgacgccgccgacgaccggccgcaccggccggccgactggaccgtccaccacaaaatctactattacgtgctggtgccggccttctcgcgggggcgctgctgcaccgcgggggtccgcttcgaccgcgtgtacgccacgctgcagaacatggtggtcccggagatcgcccccggtgaggagtgcccgagcgatcccgtgaccgaccccgcccacccgctgcatcccgccaatctggtggccaacacggtcaagcgcatgttccacaacgggcgcgtcgtcgtcgacgggcccgccatgctcacgctgcaggtgctggcgcacaacatggccgagcgcacgacggcgctgctgtgctccgcggcgcccgacgcgggcgccaacaccgcgtcgacggccaacatgcgcatcttcgacggggcgctgcacgccggcgtgctgctcatggccccccagcacctggaccacaccatccaaaatggcgaatacttctacgtcctgcccgtccacgcgctgtttgcgggcgccgaccacgtggccaacgcgcccaacttccccccggccctgcgcgacctggcgcgcgacgtccccctggtccccccggccctgggggccaactacttctcctccatccgccagcccgtggtgcagcacgcccgcgagagcgcggcgggggagaacgcgctgacctacgcgctcatggcggggtacttcaagatgagccccgtggccctgtatcaccagctcaagacgggcctccaccccgggttcgggttcaccgtcgtgcggcaggaccgcttcgtgaccgagaacgtgctgttttccgagcgcgcgtcggaggcgtactttctgggccagctccaggtggcccgccacgaaacgggcgggggggtcaacttcacgctcacccagccgcgcggaaacgtggacctgggtgtgggctacaccgccgtcgcggccacgggcaccgtccgcaaccccgttacggacatgggcaacctcccccaaaacttttacctcggccgcggggcccccccgctgctagacaacgcggccgccgtgtacctgcgcaacgcggtcgtggcgggaaaccggctggggccggcccagcccctcccggtctttggctgcgcccaggtgccgcggcgcgccggcatggaccacgggcaggatgccgtgtgtgagttcatcgccacccccgtggccacggacatcaactactttcgccggccctgcaacccgcggggacgcgcggccggcggcgtgtacgcgggggacaaggagggggacgtcatagccctcatgtacgaccacggccagagcgacccggcgcggcccttcgcggccacggccaacccgtgggcgtcgcagcggttctcgtacggggacctgctgtacaacggggcctatcacctcaacggggcctcgcccgtcctcagcccctgcttcaagttcttcaccgcggccgacatcacggccaaacatcgctgcctggagcgtctcatcgtggaaacgggatcggcggtatccacggccaccgctgccagcgacgtgcagtttaagcgcccgccggggtgccgcgagctcgtggaagacccgtgcggcctgtttcaggaagcctacccgatcacctgcgccagcgaccccgccctgctacgcagcgcccgcgatggggaggcccacgcgcgagagacccactttacgcagtatctcatctacgacgcctccccgctaaagggcctgtctctgtaa

SEQ ID NO: 77 - DNA, 8108 bp, HSV-2
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttttgcgatcaataaatggatcacaaccagtatctcttaacgatgttcttcgcagatgatgattcattttttaagtatttggctagtcaagatgatgaaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatctcttggaatcaattacagatttctccgtgataggtatcgatgaaggacagttctttccagacattgttgaattccgagcttggctgcaggtcggggatcccccctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgctgttgactgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggcggcagtaaggcggtcgggatagttttcttgcggccctaatccgagccagtttacccgctctgctacctgcgccagctggcagttcaggccaatccgcgccggatgcggtgtatcgctcgccacttcaacatcaacggtaatcgccatttgaccactaccatcaatccggtaggttttccggctgataaataaggttttcccctgatgctgccacgcgtgagcggtcgtaatcagcaccgcatcagcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgatcgcgcagcggcgtcagcagttgttttttatcgccaatccacatctgtgaaagaaagcctgactggcggttaaattgccaacgcttattacccagctcgatgcaaaaatccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttgagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccaacgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggttacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacgggatccctcgaggaattcatttatagcatagaaaaaaacaaaatgaaattctactatatttttacatacatatattctaaatatgaaagtggtgattgtgactagcgtagcatcgcttctagacatatactatatagtaataccaatactcaagactacgaaactgatacaatctcttatcatgtgggtaatgttctcgatgtcgaatagccatatgccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatcccgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgttgggaattctgtgagcgtatggcaaacgaaggaaaaattagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctctttacgcatctgtgcggtatttcacaccgcatatggtgcactctcagtaccatctgctctgatgccgcatagttaagccagtacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcag

SEQ ID NO: 78 - DNA, 2091 bp, HSV-2
atgtccgtgcgcgggcatgccgtacgccggaggcgcgcctccacccggtcccatgccccgtccgcgcatcgcgccgactcgcccgtggaggacgagcccgagggcggtggagtcgggttaatggggtacctgcgggcggtgtttaacgtggacgacgacagcgaggtcgaggccgcgggggagatggcgagcgaagagccgcccccgcgccgtcgccgggaggcccgcggtcaccccgggtcccgacgcgcgtccgaggcccgggcggcggcgcccccccgccgggcgtcctttccgcgccccaggtccgttacggccaggagccagtccgttcgcggacgccgggacagcgccatcacgcgggccccgcggggaggctacctgggcccgatggacccacgcgacgttttggggcgggtgggcggttcgcgggtggtgccctcgccgctgttcctggacgagctcaactacgaggaggacgactaccccgccgccgtcgcgcacgatgacggccccggggcgcggccttccgcgacggtcgagattctcgcgggccgcgtgtcgggcccggagctgcaggcggcattccccctggaccgcctgaccccccgagtcgccgcgtgggacgagtccgtgcgctcggccctggccctgggacatccggccgggttctacccgtgtccggatagcgcgttcgggctgtcgcgcgtgggggtcatgcactttgcctccccggccgacccaaaggtgtttttccgccagacgctgcagcagggcgaggcgctggcctggtacgtcacgggcgacgcgatcctcgacctgacggatcggcgggcaaaaaccagcccctcccgcgcgatgggttttctggtggacgccatcgtgcgggtggcgatcaacgggtgggtctgcgggacgcgcctgcacacggaggggcgcggctcggagctcgacgacagggcggccgagctccgacggcagttcgcgagcctcacggcgttgcggcccgtgggggccgccgccgtgccgctgctcagcgcgggaggggccgcgcccccccaccccggccccgacgccgcggtctttcgcagttcgctggggtccctgctgtactggcccggggtgcgcgcgctcctggggcgcgactgtcgcgtggccgcccgctacgcggggcgcatgacgtacatcgccaccggggctctgctcgcccgcttcaaccccggcgccgtcaaatgcgtgctcccgcgggaggccgcgtttgcggggcgcgtcctggacgtgctggcggtcctggcggagcagacggtccagtggctctcggtggtcgtgggggcgcgcctgcacccgcactccgcccaccccgcgtttgcggacgtggagcaggaggcgctgtttcgcgccctgcccctgggcagccccggggtcgtggcggccgagcacgaggcgctgggcgacaccgcggcgcgccgcctgctcgccaccagcgggctgaacgccgtgctgggcgcggccgtgtacgcgctgcacacggccctggcgaccgttaccctgaaatacgccctggcctgcggggacgcgcgccggcgcagggacgacgcggcggccgcgcgcgccgtgctggcgacggggctcatcctgcagcggctgctgggcctggccgacacggtggtcgcgtgcgtggccctggccgcgtttgacggcgggtcgacggcccccgaggtgggcacgtacacccccctgcgctacgcgtgcgtcctccgcgcgacccagcccctgtacgcgcggaccacccccgccaaattttgggcggacgtgcgcgccgccgcggaacacgtggaccttcgccccgcgtcctcggcgccccgggcgcccgtgagcgggacggcagaccccgccttcctgctcgaagacctggcggccttcccccccgcccccctgaatagcgagtccgtgctggggccgcgggtccgcgtcgtggacatcatggcgcagtttcggaaactgctcatgggcgacgaggagaccgccgccctccgggcgcacgtgtccgggaggcgcgcgaccgggctgggcggcccgccacgcccatag

SEQ ID NO: 79 - DNA, 1110 bp, HSV-2
atgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctag

SEQ ID NO: 80 - DNA, 228 bp, Homo sapiens-ubiquitin UL49-HSV-2
atgcagatcttcgtgaagactctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtggg

SEQ ID NO: 81 - DNA, 903 bp, Homo sapiens-ubiquitin UL49-HSV-2
atgacctctcgccgctccgtcaagtcgtgtccgcgggaagcgccgcgcgggacccacgaggagctgtactatggcccggtctccccggcggacccagagagtccgcgcgacgacttccgccgcggcgctggcccgatgcgcgcgcgcccgaggggcgaggttcgctttctccattatgacgaggctgggtatgccctctaccgggactcgtcttcggacgacgacgagtcccgggataccgcgcgaccgcgtcgttcggcgtccgtcgcgggctctcacggccccggccccgcgcgcgctcctccaccccccgggggccccgtgggcgccggcgggcgctcgcacgcccctcccgcgcggacccccaaaatgacgcgcggggcgcctaaggcctccgcgaccccggcgaccgaccccgcccgcggcaggcgacccgcccaggccgactccgccgtgctcctagacgcccccgctcccacggcctcgggaagaaccaagacacccgcccagggactggccaagaagctgcacttcagcaccgccccaccgagccccacggcgccgtggaccccccgggtggccgggttcaacaagcgcgtcttctgcgccgcggtcgggcgcctggcggccacgcacgcccggctggcggcggtacagctgtgggacatgtcgcggccgcacaccgacgaagacctcaacgagctcctcgacctcaccaccattcgcgtgacggtctgcgagggcaagaacctcctgcagcgcgcgaacgagttggtgaatcccgacgcggcgcaggacgtcgacgcgaccgcggccgcccggggccgccccgcggggcgtgccgccgcgaccgcacgggcccccgcccgctcggcttcccgtccccgccgccccctcgagtag

SEQ ID NO: 82 - DNA, 1113 bp, Homo sapiens
atgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagtga

SEQ ID NO: 83 - DNA, 927 bp, Homo sapiens
atgcagcatcaccaccatcaccaccacacctctcgccgctccgtcaagtcgtgtccgcgggaagcgccgcgcgggacccacgaggagctgtactatggcccggtctccccggcggacccagagagtccgcgcgacgacttccgccgcggcgctggcccgatgcgcgcgcgcccgaggggcgaggttcgctttctccattatgacgaggctgggtatgccctctaccgggactcgtcttcggacgacgacgagtcccgggataccgcgcgaccgcgtcgttcggcgtccgtcgcgggctctcacggccccggccccgcgcgcgctcctccaccccccgggggccccgtgggcgccggcgggcgctcgcacgcccctcccgcgcggacccccaaaatgacgcgcggggcgcctaaggcccccgcgaccccggcgaccgaccccgcccgcggcaggcgacccgcccaggccgactccgccgtgctcctagacgcccccgctcccacggcctcgggaagaaccaagacacccgcccagggactggccaagaagctgcacttcagcaccgccccaccgagccccacggcgccgtggaccccccgggtggccgggttcaacaagcgcgtcttctgcgccgcggtcgggcgcctggcggccacgcacgcccggctggcggcggtacagctgtgggacatgtcgcggccgcacaccgacgaagacctcaacgagctcctcgacctcaccaccattcgcgtgacggtctgcgagggcaagaacctcctgcagcgcgcgaacgagttggtgaatcccgacgcggcgcaggacgtcgacgcgaccgcggccgcccggggccgccccgcggggcgtgccgccgcgaccgcacgggcccccgcccgctcggcttcccgtccccgccgccccctcgagtag

SEQ ID NO: 84 - DNA, 4149 bp, Homo sapiens
atgcagcatcaccaccatcaccacgccgctcctgcccgcgaccccccgggttaccggtacgccgcggccatggtgcccaccggctccatcctgagtacgatcgaggtggcgtcccaccgcagactctttgattttttcgcccgcgtgcgctccgacgaaaacagcctgtatgacgtagagtttgacgccctgctggggtcctactgcaacaccctgtcgctcgtgcgctttctggagctcggcctgtccgtggcgtgcgtgtgcaccaagttcccggagctggcttacatgaacgaagggcgtgtgcagttcgaggtccaccagcccctcatcgcccgcgacggcccgcaccccgtcgagcagcccgtgcataattacatgacgaaggtcatcgaccgccgggccctgaacgccgccttcagcctggccaccgaggccattgccctgctcacgggggaggccctggacgggacgggcattagcctgcatcgccagctgcgcgccatccagcagctcgcgcgcaacgtccaggccgtcctgggggcgtttgagcgcggcacggccgaccagatgctgcacgtgctgttggagaaggcgcctcccctggccctgctgttgcccatgcaacgatatctcgacaacgggcgcctggcgaccagggtcgcccgggcgaccctggtcgccgagctgaagcggagcttttgcgacacgagcttcttcctgggcaaggcgggccatcgccgcgaggccatcgaggcctggctcgtggacctgaccacggcgacgcagccgtccgtggccgtgccccgcctgacgcacgccgacacgcgcgggcggccggtcgacggggtgctggtcaccaccgccgccatcaaacagcgcctcctgcagtccttcctgaaggtggaggacaccgaggccgacgtgccggtgacctacggcgagatggtcttgaacggggccaacctcgtcacggcgctggtgatgggcaaggccgtgcggagcctggacgacgtgggccgccacctgctggagatgcaggaggagcaactcgaggcgaaccgggagacgctggatgaactcgaaagcgccccccagacaacgcgcgtgcgcgcggatctggtggccataggcgacaggctggtcttcctggaggccctggagaagcgcatctacgccgccaccaacgtgccctaccccctggtgggcgccatggacctgacgttcgtcctgcccctggggctgttcaacccggccatggagcgcttcgccgcgcacgccggggacctggtgcccgcccccggccacccggagccccgcgcgttccctccccggcagctgtttttttggggaaaggaccaccaggttctgcggctgtccatggagaacgcggtcgggaccgtgtgtcatccttcgctcatgaacatcgacgcggccgtcgggggcgtgaaccacgcccccgtcgaggccgcgaacccgtacggggcgtacgtcgcggccccggccggccccggcgcggacatgcagcagcgttttctgaacgcctggcggcagcgcctcgcccacggccgggtccggtgggtcgccgagtgccagatgaccgcggagcagttcatgcagcccgacaacgccaacctggctctggagctgcaccccgcgttcgacttcttcgcgggcgtggccgacgtcgagcttcccggcggcgaagtccccccggccggtccgggggcgatccaggccacctggcgcgtggtcaacggcaacctgcccctggcgctgtgtccggtggcgtttcgtgacgcccggggcctggagctcggcgttggccgccacgccatggcgccggctaccatagccgccgtccgcggggcgttcgaggaccgcagctacccggcggtgttttacctgctgcaagccgcgattcacggcagcgagcacgtgttctgcgccctggcgcggctcgtgactcagtgcatcaccagctactggaacaacacgcgatgcgcggcgttcgtgaacgactactcgctggtctcgtacatcgtgacctacctcgggggcgacctccccgaggagtgcatggccgtgtatcgggacctggtggcccacgtcgaggccctggcccagctggtggacgactttaccctgccgggcccggagctgggcgggcaggctcaggccgagctgaatcacctgatgcgcgacccggcgctgctgccgcccctcgtgtgggactgcgacggccttatgcgacacgcggccctggaccgccaccgagactgccggattgacgcgggggggcacgagcccgtctacgcggcggcgtgcaacgtggcgacggccgactttaaccgcaacgacggccggctgctgcacaacacccaggcccgcgcggtcgacgccgccgacgaccggccgcaccggccggccgactggaccgtccaccacaaaatctactattacgtgctggtgccggccttctcgcgggggcgctgctgcaccgcgggggtccgcttcgaccgcgtgtacgccacgctgcagaacatggtggtcccggagatcgcccccggtgaggagtgcccgagcgatcccgtgaccgaccccgcccacccgctgcatcccgccaatctggtggccaacacggtcaacgccatgttccacaacgggcgcgtcgtcgtcgacgggcccgccatgctcacgctgcaggtgctggcgcacaacatggccgagcgcacgacggcgctgctgtgctccgcggcgcccgacgcgggcgccaacaccgcgtcgacggccaacatgcgcatcttcgacggggcgctgcacgccggcgtgctgctcatggccccccagcacctggaccacaccatccaaaatggcgaatacttctacgtcctgcccgtccacgcgctgtttgcgggcgccgaccacgtggccaacgcgcccaacttccccccggccctgcgcgacctggcgcgccacgtccccctggtccccccggccctgggggccaactacttctcctccatccgccagcccgtggtgcagcacgcccgcgagagcgcggcgggggagaacgcgctgacctacgcgctcatggcggggtacttcaagatgagccccgtggccctgtatcaccagctcaagacgggcctccaccccgggttcgggttcaccgtcgtgcggcaggaccgcttcgtgaccgagaacgtgctgttttccgagcgcgcgtcggaggcgtactttctgggccagctccaggtggcccgccacgaaacgggcgggggggtcagcttcacgctcacccagccgcgcggaaacgtggacctgggtgtgggctacaccgccgtcgcggccacggccaccgtccgcaaccccgttacggacatgggcaacctcccccaaaacttttacctcggccgcggggcccccccgctgctagacaacgcggccgccgtgtacctgcgcaacgcggtcgtggcgggaaaccggctggggccggcccagcccctcccggtctttggctgcgcccaggtgccgcggcgcgccggcatggaccacgggcaggatgccgtgtgtgagttcatcgccacccccgtggccacggacatcaactactttcgccggccctgcaacccgcggggacgcgcggccggcggcgtgtacgcgggggacaaggagggggacgtcatagccctcatgtacgaccacggccagagcgacccggcgcggcccttcgcggccacggccaacccgtgggcgtcgcagcggttctcgtacggggacctgctgtacaacggggcctatcacctcaacggggcctcgcccgtcctcagcccctgcttcaagttcttcaccgcggccgacatcacggccaaacatcgctgcctggagcgtcttatcgtggaaacgggatcggcggtatccacggccaccgctgccagcgacgtgcagtttaagcgcccgccggggtgccgcgagctcgtggaagacccgtgcggcctgtttcaggaagcctacccgatcacctgcgccagcgaccccgccctgctacgcagcgcccgcgatggggaggcccacgcgcgagagacccactttacgcagtatctcatctacgacgcctccccgctaaagggcctgtctctgtaatga

SEQ ID NO: 85 - DNA, 1623 bp, Homo sapiens
atgcagcatcaccaccatcaccacgagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgatga

SEQ ID NO: 86 - DNA, 2211 bp, Homo sapiens
atgcagcatcaccaccatcaccacgtgtctatcgaaggtcgtgctagctctggtggcagcggtctggttccgcgtggtagctctggttcgggggacgacgacgacaaatctagtaggcactccgtgcgcgggcatgccgtacgccggaggcgcgcctccacccggtcccatgccccgtccgcgcatcgcgccgactcgcccgtggaggacgagcccgagggcggtggagtcgggttaatggggtacctgcgggcggtgtttaacgtggacgacgacagcgaggtcgaggccgcgggggagatggcgagcgaagagccgcccccgcgccgtcgccgggaggcccgcggtcaccccgggtcccgacgcgcgtccgaggcccgggcggcggcgcccccccgccgggcgtcctttccgcgccccaggtccgttacggccaggagccagtccgttcgcggacgccgggacagcgccatcacgcgggccccgcggggaggctacctgggcccgatggacccacgcgacgttttggggcgggtgggcggttcgcgggtggtgccctcgccgctgttcctggacgagctcagctacgaggaggacgactaccccgccgccgtcgcgcacgatgacggcgccggggcgcggcctcccgcgacggtcgagattctcgcgggccgcgtgtcgggcccggagctgcaggcggcattccccctggaccgcctgaccccccgagtcgccgcgtgggacgagtccgtgcgctcggccctggccctgggacatccggccgggttctacccgtgtccggatagcgcgttcgggctgtcgcgcgtgggggtcatgcactttgcctccccggccgacccaaaggtgtttttccgccagacgctgcagcagggcgaggcgctggcctggtacgtcacgggcgacgcgatcctcgacctgacggatcggcgggcaaaaaccagcccctcccgcgcgatgggttttctggtggacgccatcgtgcgggtggcgatcaacgggtgggtctgcgggacgcgcctgcacacggaggggcgcggctcggagctcgacgacagggcggccgagctccgacggcagttcgcgagcctcacggcgttgcggcccgtgggggccgccgccgtgccgctgctcagcgcgggaggggccgcgcccccccaccccggccccgacgccgcggtctttcgcagttcgctggggtccctgctgtactggcccggggtgcgcgcgctcctggggcgcgactgtcgcgtggccgcccgctacgcggggcgcatgacgtacatcgccaccggggctctgctcgcccgcttcaaccccggcgccgtcaaatgcgtgctcccgcgggaggccgcgtttgcggggcgcgtcctggacgtgctggcggtcctggcggagcagacggtccagtggctctcggtggtcgtgggggcgcgcctgcacccgcactccgcccaccccgcgtttgcggacgtggagcaggaggcgctgtttcgcgccctgcccctgggcagccccggggtcgtggcggccgagcacgaggcgctgggcgacaccgcggcgcgccgcctgctcgccaccagcgggctgaacgccgtgctgggcgcggccgtgtacgcgctgcacacggccctggcgaccgttaccctgaaatacgccctggcctgcggggacgcgcgccggcgcagggacgacgcggcggccgcgcgcgccgtgctggcgacggggctcatcctgcagcggctgctgggcctggccgacacggtggtcgcgtgcgtggccctggccgcgtttgacggcgggtcgacggcccccgaggtgggcacgtacacccccctgcgctacgcgtgcgtcctccgcgcgacccagcccctgtacgcgcggaccacccccgccaaattttgggcggacgtgcgcgccgccgcggaacacgtggaccttcgccccgcgtcctcggcgccccgggcgcccgtgagcgggacggcagaccccgccttcctgctcgaagacctggcggccttcccccccgcccccctgaatagcgagtccgtgctggggccgcgggtccgcgtcgtggacatcatggcgcagtttcggaaactgctcatgggcgacgaggagaccgccgccctccgggcgcacgtgtccgggaggcgcgcgaccgggctgggcggcccgccacgcccatagtga

SEQ ID NO: 87 - DNA, 2118 bp, Homo sapiens
atgcagcatcaccaccatcaccaccactccgtgcgcgggcatgccgtacgccggaggcgcgcctccacccggtcccatgccccgtccgcgcatcgcgccgactcgcccgtggaggacgagcccgagggcggtggagtcgggttaatggggtacctgcgggcggtgtttaacgtggacgacgacagcgaggtcgaggccgcgggggagatggcgagcgaagagccgcccccgcgccgtcgccgggaggcccgcggtcaccccgggtcccgacgcgcgtccgaggcccgggcggcggcgcccccccgccgggcgtcctttccgcgccccaggtccgttacggccaggagccagtccgttcgcggacgccgggacagcgccatcacgcgggccccgcggggaggctacctgggcccgatggacccacgcgacgttttggggcgggtgggcggttcgcgggtggtgccctcgccgctgttcctggacgagctcagctacgaggaggacgactaccccgccgccgtcgcgcacgatgacggcgccggggcgcggcctcccgcgacggtcgagattctcgcgggccgcgtgtcgggcccggagctgcaggcggcattccccctggaccgcctgaccccccgagtcgccgcgtgggacgagtccgtgcgctcggccctggccctgggacatccggccgggttctacccgtgtccggatagcgcgttcgggctgtcgcgcgtgggggtcatgcactttgcctccccggccgacccaaaggtgtttttccgccagacgctgcagcagggcgaggcgctggcctggtacgtcacgggcgacgcgatcctcgacctgacggatcggcgggcaaaaaccagcccctcccgcgcgatgggttttctggtggacgccatcgtgcgggtggcgatcaacgggtgggtctgcgggacgcgcctgcacacggaggggcgcggctcggagctcgacgacagggcggccgagctccgacggcagttcgcgagcctcacggcgttgcggcccgtgggggccgccgccgtgccgctgctcagcgcgggaggggccgcgcccccccaccccggccccgacgccgcggtctttcgcagttcgctggggtccctgctgtactggcccggggtgcgcgcgctcctggggcgcgactgtcgcgtggccgcccgctacgcggggcgcatgacgtacatcgccaccggggctctgctcgcccgcttcaaccccggcgccgtcaaatgcgtgctcccgcgggaggccgcgtttgcggggcgcgtcctggacgtgctggcggtcctggcggagcagacggtccagtggctctcggtggtcgtgggggcgcgcctgcacccgcactccgcccaccccgcgtttgcggacgtggagcaggaggcgctgtttcgcgccctgcccctgggcagccccggggtcgtggcggccgagcacgaggcgctgggcgacaccgcggcgcgccgcctgctcgccaccagcgggctgaacgccgtgctgggcgcggccgtgtacgcgctgcacacggccctggcgaccgttaccctgaaatacgccctggcctgcggggacgcgcgccggcgcagggacgacgcggcggccgcgcgcgccgtgctggcgacggggctcatcctgcagcggctgctgggcctggccgacacggtggtcgcgtgcgtggccctggccgcgtttgacggcgggtcgacggcccccgaggtgggcacgtacacccccctgcgctacgcgtgcgtcctccgcgcgacccagcccctgtacgcgcggaccacccccgccaaattttgggcggacgtgcgcgccgccgcggaacacgtggaccttcgccccgcgtcctcggcgccccgggcgcccgtgagcgggacggcagaccccgccttcctgctcgaagacctggcggccttcccccccgcccccctgaatagcgagtccgtgctggggccgcgggtccgcgtcgtggacatcatggcgcagtttcggaaactgctcatgggcgacgaggagaccgccgccctccgggcgcacgtgtccgggaggcgcgcgaccgggctgggcggcccgccacgcccatagtga

SEQ ID NO: 88 - DNA, 939 bp, Homo sapiens
atgcagcatcaccaccatcaccaccactccgtgcgcgggcatgccgtacgccggaggcgcgcctccacccggtcccatgccccgtccgcgcatcgcgccgactcgcccgtggaggacgagcccgagggcggtggagtcgggttaatggggtacctgcgggcggtgtttaacgtggacgacgacagtgaggtcgaggccgcgggggagatggcgagcgaagagccgcccccgcgccgtcgccgggaggcccgcggtcaccccgggtcccgacgcgcgtccgaggcccgggcggcggcgcccccccgccgggcgtcctttccgcgccccaggtccgttacggccaggagccagtccgttcgcggacgccgggacagcgccatcacgcgggccccgcggggaggctacctgggcccgatggacccacgcgacgttttggggcgggtgggcggttcgcgggtggtgccctcgccgctgttcctggacgagctcagctacgaggaggacgactaccccgccgccgtcgcgcacgatgacggcgccggggcgcggcctcccgcgacggtcgagattctcgcgggccgcgtgtcgggcccggagctgcaggcggcattccccctggaccgcctgaccccccgagtcgccgcgtgggacgagtccgtgcgctcggccctggccctgggacatccggccgggttctacccgtgtccggatagcgcgttcgggctgtcgcgcgtgggggtcatgcactttgcctccccggccgacccaaaggtgtttttccgccagacgctgcagcagggcgaggcgctggcctggtacgtcacgggcgacgcgatcctcgacctgacggatcggcgggcaaaaaccagcccctcccgcgcgatgggctttctggtggacgccatcgtgcgggtggcgatcaacgggtgggtctgatga

SEQ ID NO: 89 - DNA, 843 bp, Homo sapiens
atgcagcatcaccaccatcaccaccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctggggattctggttcacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggttcctggcgtgccgggcgacccgcggcatgcgccacatcgccctggggcgacaggggtcgtggtgggaaatgttcaagttctttttccaccgcctctactaatga

SEQ ID NO: 90 - protein, 279 aa, Homo sapiens
MQHHHHHHHAAAPQADVAPVLDSQPTVGTDPGYPVPLELTPENAEAVARFLGDAVDREPALMLEYFCRCAREESKRVPPRTFGSAPRLTEDDFGLLNYALAEMRRLCLDLPPVPPNAYTPYHLREYATRLVNGFKPLVRRSARLYRILGILVHLRIRTREASFEEWMRSKEVDLDFGLTERLREHEAQLMILAQALNPYDCLIHSTPNTLVERGLQSALKYEEFYLKRFGGHYMESVFQMYTRIAGFLACRATRGMRHIALGRQGSWWEMFKFFFHRLY

SEQ ID NO: 91 - protein, 539 aa, Homo sapiens
MQHHHHHHELSYATTLHHRDVVFYVTADRNRAYFVCGGSVYSVGRPRDSQPGEIAKFGLVVRGTGPKDRMVANYVRSELRQRGLRDVRPVGEDEVFLDSVCLLNPNVSSERDVINTNDVEVLDECLAEYCTSLRTSPGVLVTGVRVRARDRVIELFEHPAIVNISSRFAYTPSPYVFALAQAHLPRLPSSLEPLVSGLFDGIPAPRQPLDARDRRTDVVITGTRAPRPMAGTGAGGAGAKRATVSEFVQVKHIDRVVSPSVSSAPPPSAPDASLPPPGLQEAAPPGPPLRELWWVFYAGDRALEEPHAESGLTREEVRAVHGFREQAWKLFGSVGAPRAFLGAALALSPTQKLAVYYYLIHRERRMSPFPALVRLVGRYIQRHGLYVPAPDEPTLADAMNGLFRDALAAGTVAEQLLMFDLLPPKDVPVGSDARADSAALLRFVDSQRLTPGGSVSPEHVMYLGAFLGVLYAGHGRLAAATHTARLTGVTSLVLTVGDVDRMSAFDRGPAGAAGRTRTAGYLDALLTVCLARAQHGQSV

SEQ ID NO: 92 - protein, 858 aa, Homo sapiens
MQHHHHHHMSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMQHHHHHHVSIEGRASSGGSGLVPRGSSGSGDDDDKSSRHSVRGHAVRRRRASTRSHAPSAHRADSPVEDEPEGGGVGLMGYLRAVFNVDDDSEVEAAGEMASEEPPPRRRREARGHPGSRRASEARAAAPPRRASFPRPRSVTARSQSVRGRRDSAITRAPRGGYLGPMDPRDVLGRVGGSRVVPSPLFLDELSYEEDDYPAAVAHDDGAGARPPATVEILAGRVSGPELQAAFPLDRLTPRVAAWDESVRSALALGHPAGFYPCPDSAFGLSRVGVMHFASPADPKVFFRQTLQQGEALAWYVTGDAILDLTDRRAKTSPSRAMGFLVDAIVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQRLLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAALRAHVSGRRATGLGGPPRP

SEQ ID NO: 93 - protein, 311 aa, Homo sapiens
MQHHHHHHHSVRGHAVRRRRASTRSHAPSAHRADSPVEDEPEGGGVGLMGYLRAVFNVDDDSEVEAAGEMASEEPPPRRRREARGHPGSRRASEARAAAPPRRASFPRPRSVTARSQSVRGRRDSAITRAPRGGYLGPMDPRDVLGRVGGSRVVPSPLFLDELSYEEDDYPAAVAHDDGAGARPPATVEILAGRVSGPELQAAFPLDRLTPRVAAWDESVRSALALGHPAGFYPCPDSAFGLSRVGVMHFASPADPKVFFRQTLQQGEALAWYVTGDAILDLTDRRAKTSPSRAMGFLVDAIVRVAINGWV

SEQ ID NO: 94 - protein, 704 aa, Homo sapiens
MQHHHHHHHSVRGHAVRRRRASTRSHAPSAHRADSPVEDEPEGGGVGLMGYLRAVFNVDDDSEVEAAGEMASEEPPPRRRREARGHPGSRRASEARAAAPPRRASFPRPRSVTARSQSVRGRRDSAITRAPRGGYLGPMDPRDVLGRVGGSRVVPSPLFLDELSYEEDDYPAAVAHDDGAGARPPATVEILAGRVSGPELQAAFPLDRLTPRVAAWDESVRSALALGHPAGFYPCPDSAFGLSRVGVMHFASPADPKVFFRQTLQQGEALAWYVTGDAILDLTDRRAKTSPSRAMGFLVDAIVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQRLLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAALRAHVSGRRATGLGGPPRP

SEQ ID NO: 95 - protein, 1381 aa, Homo sapiens
MQHHHHHHAAPARDPPGYRYAAAMVPTGSILSTIEVASHRRLFDFFARVRSDENSLYDVEFDALLGSYCNTLSLVRFLELGLSVACVCTKFPELAYMNEGRVQFEVHQPLIARDGPHPVEQPVHNYMTKVIDRRALNAAFSLATEAIALLTGEALDGTGISLHRQLRAIQQLARNVQAVLGAFERGTADQMLHVLLEKAPPLALLLPMQRYLDNGRLATRVARATLVAELKRSFCDTSFFLGKAGHRREAIEAWLVDLTTATQPSVAVPRLTHADTRGRPVDGVLVTTAAIKQRLLQSFLKVEDTEADVPVTYGEMVLNGANLVTALVMGKAVRSLDDVGRHLLEMQEEQLEANRETLDELESAPQTTRVRADLVAIGDRLVFLEALEKRIYAATNVPYPLVGAMDLTFVLPLGLFNPAMERFAAHAGDLVPAPGHPEPRAFPPRQLFFWGKDHQVLRLSMENAVGTVCHPSLMNIDAAVGGVNHAPVEAANPYGAYVAAPAGPGADMQQRFLNAWRQRLAHGRVRWVAECQMTAEQFMQPDNANLALELHPAFDFFAGVADVELPGGEVPPAGPGAIQATWRVVNGNLPLALCPVAFRDARGLELGVGRHAMAPATIAAVRGAFEDRSYPAVFYLLQAAIHGSEHVFCALARLVTQCITSYWNNTRCAAFVNDYSLVSYIVTYLGGDLPEECMAVYRDLVAHVEALAQLVDDFTLPGPELGGQAQAELNHLMRDPALLPPLVWDCDGLMRHAALDRHRDCRIDAGGHEPVYAAACNVATADFNRNDGRLLHNTQARAVDAADDRPHRPADWTVHHKIYYYVLVPAFSRGRCCTAGVRFDRVYATLQNMVVPEIAPGEECPSDPVTDPAHPLHPANLVANTVNAMFHNGRVVVDGPAMLTLQVLAHNMAERTTALLCSAAPDAGANTASTANMRIFDGALHAGVLLMAPQHLDHTIQNGEYFYVLPVHALFAGADHVANAPNFPPALRDLARHVPLVPPALGANYFSSIRQPVVQHARESAAGENALTYALMAGYFKMSPVALYHQLKTGLHPGFGFTVVRQDRFVTENVLFSERASEAYFLGQLQVARHETGGGVSFTLTQPRGNVDLGVGYTAVAATATVRNPVTDMGNLPQNFYLGRGAPPLLDNAAAVYLRNAVVAGNRLGPAQPLPVFGCAQVPRRAGMDHGQDAVCEFIATPVATDINYFRRPCNPRGRAAGGVYAGDKEGDVIALMYDHGQSDPARPFAATANPWASQRFSYGDLLYNGAYHLNGASPVLSPCFKFFTAADITAKHRCLERLIVETGSAVSTATAASDVQFKRPPGCRELVEDPCGLFQEAYPITCASDPALLRSARDGEAHARETHFTQYLIYDASPLKGLSL

SEQ ID NO: 96 - protein, 377 aa, Homo sapiens
MQHHHHHHHSQWGPRAILVQTDSTNRNADGDWQAAVAIRGGGVVQLNMVNKRAVDFTPAECGDSEWAVGRVSLGLRMAMPRDFCAIIHAPAVSGPGPHVMLGLVDSGYRGTVLAVVVAPNGTRGFAPGALRVDVTFLDIRATPPTLTEPSSLHRFPQLAPSPLAGLREDPWLDGALATAGGAVALPARRRGGSLVYAGELTQVTTEHGDCVHEAPAFLPKREEDAGFDILIHRAVTVPANGATVIQPSLRVLRAADGPEACYVLGRSSLNARGLLVMPTRWPSGHACAFVVCNLTGVPVTLQAGSKVAQLLVAGTHALPWIPPDNIHEDGAFRAYPRGVPDATATPRDPPILVFTNEFDADAPPSKRGAGGFGSTGI

SEQ ID NO: 97 - protein, 308 aa, Homo sapiens
MQHHHHHHHTSRRSVKSCPREAPRGTHEELYYGPVSPADPESPRDDFRRGAGPMRARPRGEVRFLHYDEAGYALYRDSSSDDDESRDTARPRRSASVAGSHGPGPARAPPPPGGPVGAGGRSHAPPARTPKMTRGAPKAPATPATDPARGRRPAQADSAVLLDAPAPTASGRTKTPAQGLAKKLHFSTAPPSPTAPWTPRVAGFNKRVFCAAVGRLAATHARLAAVQLWDMSRPHTDEDLNELLDLTTIRVTVCEGKNLLQRANELVNPDAAQDVDATAAARGRPAGRAAATARAPARSASRPRRPLE

SEQ ID NO: 98 - DNA, 21 bp, Artificial Sequence
  PCR primer
gagctcagctatgccaccacc

SEQ ID NO: 99 - DNA, 33 bp, Artificial Sequence
  PCR primer
cggcgaattcattagtagaggcggtggaaaaag

SEQ ID NO: 100 - DNA, 24 bp, Artificial Sequence
  PCR primer
cacgccgccgcaccccaggcggac

SEQ ID NO: 101 - DNA, 33 bp, Artificial Sequence; identical to SEQ ID NO: 99
  PCR primer

SEQ ID NO: 102 - DNA, 26 bp, Artificial Sequence
  PCR primer
cacacctctcgccgctccgtcaagtc

SEQ ID NO: 103 - DNA, 36 bp, Artificial Sequence
  PCR primer
cataagaattcactactcgagggggcggcggggacg

SEQ ID NO: 104 - DNA, 28 bp, Artificial Sequence
  PCR primer
cacagtcagtgggggcccagggcgatcc

SEQ ID NO: 105 - DNA, 35 bp, Artificial Sequence
  PCR primer
cctagaattcactagatgccagtggagccaaaccc

SEQ ID NO: 106 - DNA, 23 bp, Artificial Sequence
  PCR primer
gccgctcctgcccgcgacccccc

SEQ ID NO: 107 - DNA, 32 bp, Artificial Sequence
  PCR primer
ccagaattcattacagagacaggccctttagc

SEQ ID NO: 108 - DNA, 23 bp, Artificial Sequence
  PCR primer
cactccgtggcgcgggcatgccg

SEQ ID NO: 109 - DNA, 31 bp, Artificial Sequence
  PCR primer
ccgttagaattcactatgggcgtggcgggcc

SEQ ID NO: 110 - DNA, 22 bp, Artificial Sequence
  PCR primer
cactccgtgcgcgggcatgccg

SEQ ID NO: 111 - DNA, 38 bp, Artificial Sequence
  PCR primer
catagaattcatcacgcgcgggaggggctggtttttgc

SEQ ID NO: 112 - DNA, 23 bp, Artificial Sequence
  PCR primer
gacacggtggtcgcgtgcgtggc

SEQ ID NO: 113 - DNA, 31 bp, Artificial Sequence; identical to SEQ ID NO: 109
  PCR primer

SEQ ID NO: 114 - DNA, 22 bp, Artificial Sequence
  PCR primer
cactccgtgcgcgggcatgccg

SEQ ID NO: 115 - DNA, 28 bp, Artificial Sequence
  PCR primer
cgtatgaattcatcagacccacccgttg

SEQ ID NO: 116 - DNA, 22 bp, Artificial Sequence
  PCR primer
gtgctggcgacggggctcatcc

SEQ ID NO: 117 - DNA, 31 bp, Artificial Sequence; identical to SEQ ID NO: 109
  PCR primer

SEQ ID NO: 118 - DNA, 783 bp, HSV-2
atggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactatgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaaccccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttga

SEQ ID NO: 119 - DNA, 1638 bp, HSV-2
atggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgacgaacgcacgccggtcagcgttccccccccaaccccccccccgtcgtccccccgtcgcccccccgacgcaccctcgtgttatccccgaggtgtcccacgtgcgcggggtaacggtccatatggagaccctggaggccattctgtttgcccccggggagacgtttgggacgaacgtctccatccacgccattgcccacgacgacggtccgtacgccatggacgtcgtctggatgcggtttgacgtgccgtcctcgtgcgccgatatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaa

SEQ ID NO: 120 - protein, 260 aa, HSV-2
MARGAGLVFFVGVWVVSCLAAAPRTSWKRVTSGEDVVLLPAPAERTRAHKLLWAAEPLDACGPLRPSWVALWPPRRVLETVVDAACMRAPEPLAIAYSPPFPAGDEGLYSELAWRDRVAVVNESLVIYGALETDSGLYTLSVVGLSDEARQVASVVLVVEPAPVPTPTPDDYDEEDDAGVSERTPVSVPPPTPPPSSPRRPPDAPSCYPRGVPRARGNGPYGDPGGHSVCPRGDVWDERLHPRHCPRRRSVRHGRRLDAV

SEQ ID NO: 121 - protein, 545 aa, HSV-2
MARGAGLVFFVGVWVVSCLAAAPRTSWKRVTSGEDVVLLPAPAERTRAHKLLWAAEPLDACGPLRPSWVALWPPRRVLETVVDAACMRAPEPLAIAYSPPFPAGDEGLYSELAWRDRVAVVNESLVIYGALETDSGLYTLSVVGLSDEARQVASVVLVVEPAPVPTPTPDDYDEEDDAGVTNARRSAFPPQPPPRRPPVAPPTHPRVIPEVSHVRGVTVHMETLEAILFAPGETFGTNVSIHAIAHDDGPYAMDVVWMRFDVPSSCADMRIYEACLYHPQLPECLSPADAPCAVSSWAYRLAVRSYAGCSRTTPPPRCFAEARMEPVPGLAWLASTVNLEFQHASPQHAGLYLCVVYVDDHIHAWGHMTISTAAQYRNAVVEQHLPQRQPEPVEPTRPHVRAPHPAPSARGPLRLGAVLGAALLLAALGLSAWACMTCWRRRSWRAVKSRASATGPTYIRVADSELYADWSSDSEGERDGSLWQDPPERPDSPSTNGSGFEILSPTAPSVYPHSEGRKSRRPLTTFGSGSPGRRHSQASYPSVLW

SEQ ID NO: 122 - protein, 15 aa, Artificial Sequence
  Synthetic peptide
VGAAAVPLLSAGGAA

SEQ ID NO: 123 - protein, 15 aa, Artificial Sequence
  Synthetic peptide
PHPGPDAAVFRSSLG

SEQ ID NO: 124 - protein, 11 aa, Artificial Sequence
  Synthetic peptide
MTYIATGALLA

SEQ ID NO: 125 - protein, 15 aa, Artificial Sequence
  Synthetic peptide
EAAFAGRVLDVLAVL

SEQ ID NO: 126 - protein, 15 aa, Artificial Sequence
  Synthetic peptide
ARLHPHSAHPAFADV

SEQ ID NO: 127 - protein, 15 aa, Artificial Sequence
  Synthetic peptide
SPNTDVRMYSGKRNG

SEQ ID NO: 128 - protein, 15 aa, Artificial Sequence
  Synthetic peptide
YLAAPTGIPPAFFPI

SEQ ID NO: 129 - protein, 15 aa, Artificial Sequence
  Synthetic peptide
GVAAATPRPDPEDGA

SEQ ID NO: 130 - protein, 15 aa, Artificial Sequence
  Synthetic peptide
EEIPWVRVYENICPR

SEQ ID NO: 131 - protein, 15 aa, Artificial Sequence
  Synthetic peptide
PGDAPDSPYIEAENP

SEQ ID NO: 132 - protein, 15 aa, Artificial Sequence
  Synthetic peptide
PDSPYIEAENPLYDW

SEQ ID NO: 133 - protein, 15 aa, Artificial Sequence
  Synthetic peptide
ENPLYDWGGSALFSP

SEQ ID NO: 134 - protein, 15 aa, Artificial Sequence
  Synthetic peptide
AVPLLSAGGAAPPHP

SEQ ID NO: 135 - protein, 15 aa, Artificial Sequence
  Synthetic peptide
ELYYGPVSPADPESP

SEQ ID NO: 136 - protein, 15 aa, Artificial Sequence
  Synthetic peptide
PMRARPRGEVRFLHY

SEQ ID NO: 137 - protein, 15 aa, Artificial Sequence
  Synthetic peptide
RPRGEVRFLHYDEAG

SEQ ID NO: 138 - protein, 15 aa, Artificial Sequence
  Synthetic peptide
VAGFNKRVFCAAVGR

SEQ ID NO: 139 - protein, 15 aa, Artificial Sequence
  Synthetic peptide
AIDYVHCEGIIHRDI

SEQ ID NO: 140 - protein, 15 aa, Artificial Sequence
  Synthetic peptide
AFPVALHAVDAPSQF

SEQ ID NO: 141 - DNA, 1808 bp, HSV-2
atggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgaaccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcctcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccaacgcacgcggaatcgcgcctcaccgcgcactaccgctcgcgggcggccgggaacaatcgtccggcgtggacccgaccggcatggacccgctactacaagatccacacagacgtcgaatatctcatctgcaaagcccttacctttgacgcggcgctccgcccaagcgccgcggagttgctgcgcctgccgctatttcaccctaagtgaccccgctccccccggggggcgtggagggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacaacgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttcc

SEQ ID NO: 142 - protein, 248 aa, HSV-2
MHAIAPRLLLLFVLSGLPGTRGGSGVPGPINPPNNDVVFPGGSPVAQYCYAYPRLDDPGPLGSADAGRQDLPRRVVRHEPLGRSFLTGGLVLLAPPVRGFGAPNATYAARVTYYRLTRACRQPILLRQYGGCRGGEPPSPKTCGSYTYTYQGGGPPTRYALVNASLLVPIWDRAAETFEYQIELGGELHVGLLWVEVGGEGPGPTAPPQAARAEGGPCVPPVPAGRPWRSVPPVWYSAPNPGFRGLRF

SEQ ID NO: 143 - protein, 699 aa, HSV-2
MHAIAPRLLLLFVLSGLPGTRGGSGVPGPINPPNSDVVFPGGSPVAQYCYAYPRLDDPGPLGSADAGRQDLPRRVVRHEPLGRSFLTGGLVLLAPPVRGFGAPNATYAARVTYYRLTRACRQPILLRQYGGCRGGEPPSPKTCGSYTYTYQGGGPPTRYALVNASLLVPIWDRAAETFEYQIELGGELHVGLLWVEVGGEGPGPTAPPQAARAEGGPCVPPVPAGRPWRSVPPVWYSAPNPGFRGLRFRERCLPPQTPAAPSDLPRVAFAPQSLLVGITGRTFIRMARPTEDVGVLPPHWAPGALDDGPYAPFPPRPRFRRALRTDPEGVDPDVRAPRTGRRLMALTEDTSSDSPTSAPEKTPLPVSATAMAPSVDPSAEPTAPATTTPPDEMATQAATVAVTPEETAVASPPATASVESSPLPAAAAATPGAGHTNTSSASAAKTPPTTPAPTTPPPTSTHATPRPTTPGPQTTPPGPATPGPVGASAAPTADSPLTASPPATAPGPSAANVSVAATTATPGTRGTARTPPTDPKTHPHGPADAPPGSPAPPPPEHRGGPEEFEGAGDGEPPEDDDSATGLAFRTPNPNKPPPARPGPIRPTLPPGILGPLAPNTPRPPAQAPAKDMPSGPTPQHIPLFWFLTASPALDILFIISTTIHTAAFVCLVALAAQLWRGRAGRRRYAHPSVRYVCLPPERD

SEQ ID NO: 144 - DNA, 1599 bp, HSV2
atggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtga

SEQ ID NO: 145 - DNA, 1110 bp, HSV2; identical to SEQ ID NO: 79

SEQ ID NO: 146 - DNA, 1446 bp, HSV2
atggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacacgggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcaaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtga

SEQ ID NO: 147 - DNA, 1539 bp, HSV2
atggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaaaccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttag

SEQ ID NO: 148 - DNA, 1638 bp, HSV2; identical to SEQ ID NO: 119

SEQ ID NO: 149 - DNA, 4125 bp, HSV2; identical to SEQ ID NO: 76

SEQ ID NO: 150 - DNA, 2169 bp, HSV2
atgcaacgccgggcgcgcggcgcgagctccctgcggctggcgcggtgcctgacgccggccaacctcatccgcggcgccaacgcgggcgtccccgagcggcgcatcttcgccgggtgtctgctccccaccccggaggggctcctcagcgcggccgtgggcgtcctgcggcagcgcgccgacgacctgcagccggcgtttctgaccggcgccgatcgcagcgtccggctggcggcgcggcaccataacaccgtccccgagagcctgatcgtagacgggctcgccagcgacccgcactacgactacatccggcactacgcgtcggccgccaagcaggcgctcggcgaggtggagctgtcgggcggccagctgagccgcgccatcctagcgcagtactggaagtacctccagacggtcgtgcccagcggcctggacatccccgacgacccggcgggcgactgcgaccccagcctgcacgtgctgctgcggcccaccctgctcccgaagctgctggtgcgcgccccgttcaagagcggggccgccgcggccaagtacgccgccgcggtggcggggttgcgcgacgcggcccacaggctccagcagtacatgttctttatgcgccccgcagacccgagccggccgagcacggacaccgcactgcggctgagcgagctcctggcctacgtctccgtgttgtaccattgggcctcgtggatgctgtggacggcggacaagtacgtgtgtcgccgcctgggccccgccgatcgccggttcgtggcgctcagcgggagtctggaggcgcccgcggagacgtttgcgcgccacctggaccgcgggcccagcggcaccacgggctcgatgcagtgcatggccctgcgggcggcggtcagcgacgtcctgggccacctgacgcgcctggcccacctgtgggagaccggcaagcgcagcggcggcacgtacgggatcgtggacgccatcgtctcgaccgtcgaggttctatccatagtccaccaccacgcccagtatataattaacgcgacgcttaccgggtatgtcgtctgggcctccgacagcctgaacaacgagtaccttacggcggcggtggacagccaggagcgcttctgcaggaccgccgcccccctgttccccacgatgaccgccccgagctgggcccggatggaactcagcatcaagtcctggttcggggccgccctggccccggacctgcttcggagcggaaccccgtcgccccactacgagtccatcctgcgcctcgcggcgtccggcccaccggggggccgcggcgcggtcggcgggagctgccgggacaagatacaacggacccggcgcgacaacgcacccccgccgctcccccgggctcgcccccactcgacccccgcggcccctcggaggtgcaggcgccaccgcgaggacctccccgagcccccgcacgtcgacgcggccgaccggggtcccgagccctgcgccggccggccggccacgtattacacgcatatggccggggcgcccccgcgcctcccgccccgcaaccccgcgccccccgagcagcggccggcagccgcggcgcgcccgctcgcggctcagcgcgaggccgccggggtctacgacgcggtgcggacctgggggccggacgcggaggccgaaccggaccagatggaaaacacgtatctgctgcccgacgatgacgccgccatgcccgcgggcgtcgggcttggcgccacccccgccgccgacaccaccgccgccgccgcctggccggccgaaagccacgccccccgcgccccctccgaggacgcagattccatttacgagtcggtgggcgaggatggggggcgcgtctacgaggagatcccctgggttcgggtatacgaaaacatctgccctcgccggcgtcttgccggcggggccgccctgccgggagacgccccggactccccgtacatcgaggcggaaaatcccctgtacgactggggcgggtctgccctcttctcccctcggcgggccacacgcgccccggacccgggactaagcctgtcgcccatgcccgcccgcccccggaccaacgcgctggccaacgacggcccgacgaacgtcgccgccctcagcgccctgttgacgaagctcaaacgcggccgacaccagagccattaa

SEQ ID NO: 151 - DNA, 957 bp, HSV2
atgatcacggattgtttcgaagcagacatcgcgatcccctcgggtatctcgcgccccgatgccgcggcgctgcagcggtgcgagggtcgagtggtctttctgccgaccatccgccgccagctggcgctcgcggacgtggcgcacgaatcgttcgtctccggaggagttagtcccgacacgttggggttgttgctggcgtaccgcaggcgcttccccgcggtaatcacgcgggtgctgcccacgcgaatcgtcgcctgccccgtggacctggggctcacgcacgccggcaccgtcaatctccgcaacacctcccccgtcgacctctgcaacggggatcccgtcagcctcgtcccgcccgtcttcgagggccaggcgacggacgtgcgcctggagtcgctggacctcacgctgcggtttccggtcccgctcccaacgcccctggcccgcgagatagtcgcgcggctggtcgcccggggcatccgggacctcaaccccgacccccggacgcccggggagctccccgacctcaacgtgctgtattacaacggggcccgtctctcgctcgtggccgacgtccagcaactcgcctccgtaaacaccgagctgcggtcgctcgtcctcaacatggtctactccataaccgaaggaaccaccctcatcctcacgctcatcccccggctgctcgcgctgagcgcccaggacggatacgtgaacgcgctcctgcagatgcagagcgtcacgcgagaagccgcccagctcatccaccccgaagcccccatgctgatgcaggacggcgaacgcaggctgccgctttacgaggcgctggtcgcctggctggcgcacgcgggccaactcggggacatcctggccctggccccggcggttcgggtgtgtacgttcgacggcgccgccgttgtgcaatccggcgacatggccccggttatccgctacccctga

SEQ ID NO: 152 - DNA, 3066 bp, HSV2
atggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgtgggggtgggcccgtgggtgaggaggaagcggaagcgggaggggggggcgacgtgtgtgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaacccgcggacggccccgcgctccctgtcgctggggggacacacggtccgcgccctgtcgcccacccccccgtggcccggcacggacgacgaggacgatgacctggccgacggtgagggcgggcgggggtcgggcggggggcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgagacagccccgcgcggcccaggagccccccatagtcatcagcgactctcccccgccgtctccgcgccgccccgcgggccccgggccgctctcctttgtctcctcctcctccgcacaggtgtcctcgggccccggggggggaggtctgccacagtcgtcggggcgcgccgcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccccgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgcctcctcctcctccgcctcctcctcctccgcctcctcctcctccgcctcctcctcctccgcctcctcctcctccgcctcctcctcctccgcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtag

SEQ ID NO: 153 - protein, 369 aa, HSV2
MSQWGPRAILVQTDSTNRNADGDWQAAVAIRGGGVVQLNMVNKRAVDFTPAECGDSEWAVGRVSLGLRMAMPRDFCAIIHAPAVSGPGPHVMLGLVDSGYRGTVLAVVVAPNGTRGFAPGALRVDVTFLDIRATPPTLTEPSSLHRFPQLAPSPLAGLREDPWLDGALATAGGAVALPARRRGGSLVYAGELTQVTTEHGDCVHEAPAFLPKREEDAGFDILIHRAVTVPANGATVIQPSLRVLRAADGPEACYVLGRSSLNARGLLVMPTRWPSGHACAFVVCNLTGVPVTLQAGSKVAQLLVAGTHALPWIPPDNIHEDGAFRAYPRGVPDATATPRDPPILVFTNEFDADAPPSKRGAGGFGSTGI

SEQ ID NO: 154 - protein, 532 aa, HSV2
MELSYATTLHHRDVVFYVTADRNRAYFVCGGSVYSVGRPRDSQPGEIAKFGLVVRGTGPKDRMVANYVRSELRQRGLRDVRPVGEDEVFLDSVCLLNPNVSSERDVINTNDVEVLDECLAEYCTSLRTSPGVLVTGVRVRARDRVIELFEHPAIVNISSRFAYTPSPYVFALAQAHLPRLPSSLEPLVSGLFDGIPAPRQPLDARDRRTDVVITGTRAPRPMAGTGAGGAGAKRATVSEFVQVKHIDRVVSPSVSSAPPPSAPDASLPPPGLQEAAPPGPPLRELWWVFYAGDRALEEPHAESGLTREEVRAVHGFREQAWKLFGSVGAPRAFLGAALALSPTQKLAVYYYLIHRERRMSPFPALVRLVGRYIQRHGLYVPAPDEPTLADAMNGLFRDALAAGTVAEQLLMFDLLPPKDVPVGSDARADSAALLRFVDSQRLTPGGSVSPEHVMYLGAFLGVLYAGHGRLAAATHTARLTGVTSLVLTVGDVDRMSAFDRGPAGAAGRTRTAGYLDALLTVCLARAQHGQSV

SEQ ID NO: 155 - protein, 481 aa, HSV2; identical to SEQ ID NO: 12

SEQ ID NO: 156 - protein, 512 aa, HSV2
MATDIDMLIDLGLDLSDSELEEDALERDEEGRRDDPESDSSGECSSSDEDMEDPCGDGGAEAIDAAIPKGPPARPEDAGTPEASTPRPAARRGADDPPPATTGVWSRLGTRRSASPREPHGGKVARIQPPSTKAPHPRGGRRGRRRGRGRYGPGGADSTPKPRRRVSRNAHNQGGRHPASARTDGPGATHGEARRGGEQLDVSGGPRPRGTRQAPPPLMALSLTPPHADGRAPVPERKAPSADTIDPAVRAVLRSISERAAVERISESFGRSALVMQDPFGGMPFPAANSPWAPVLATQAGGFDAETRRVSWETLVAHGPSLYRTFAANPRAASTAKAMRDCVLRQENLIEALASADETLAWCKMCIHHNLPLRPQDPIIGTAAAVLENLATRLRPFLQCYLKARGLCGLDDLCSRRRLSDIKDIASFVLVILARLANRVERGVSEIDYTTVGVGAGETMHFYIPGACMAGLIEILDTHRQECSSRVCELTASHTIAPLYVHGKYFYCNSLF

SEQ ID NO: 157 - protein, 545 aa, HSV2; identical to SEQ ID NO: 121

SEQ ID NO: 158 - protein, 1374 aa, HSV2
MAAPARDPPGYRYAAAILPTGSILSTIEVASHRRLFDFFAAVRSDENSLYDVEFDALLGSYCNTLSLVRFLELGLSVACVCTKFPELAYMNEGRVQFEVHQPLIARDGPHPVEQPVHNYMTKVIDRRALNAAFSLATEAIALLTGEALDGTGISLHRQLRAIQQLARNVQAVLGAFERGTADQMLHVLLEKAPPLALLLPMQRYLDNGRLATRVARATLVAELKRSFCDTSFFLGKAGHRREAIEAWLVDLTTATQPSVAVPRLTHADTRGRPVDGVLVTTAAIKQRLLQSFLKVEDTEADVPVTYGEMVLNGANLVTALVMGKAVRSLDDVGRHLLDMQEEQLEANRETLDELESAPQTTRVRADLVAIGDRLVFLEALERRIYAATNVPYPLVGAMDLTFVLPLGLFNPAMERFAAHAGDLVPAPGHPEPRAFPPRQLFFWGKDHQVLRLSMENAVGTVCHPSLMNIDAAVGGVNHDPVEAANPYGAYVAAPAGPGADMQQRFLNAWRQRLAHGRVRWVAECQMTAEQFMQPDNANLALELHPAFDFFAGVADVELPGGEVPPAGPGAIQATWRVVNGNLPLALCPVAFRDARGLELGVGRHAMAPATIAAVRGAFEDRSYPAVFYLLQAAIHGNEHVFCALARLVTQCITSYWNNTRCAAFVNDYSLVSYIVTYLGGDLPEECMAVYRDLVAHVEALAQLVDDFTLPGPELGGQAQAELNHLMRDPALLPPLVWDCDGLMRHAALDRHRDCRIDAGGHEPVYAAACNVATADFNRNDGRLLHNTQARAADAADDRPHRPADWTVHHKIYYYVLVPAFSRGRCCTAGVRFDRVYATLQNMVVPEIAPGEECPSDPVTDPAHPLHPANLVANTVKRMFHNGRVVVDGPAMLTLQVLAHNMAERTTALLCSAAPDAGANTASTANMRIFDGALHAGVLLMAPQHLDHTIQNGEYFYVLPVHALFAGADHVANAPNFPPALRDLARDVPLVPPALGANYFSSIRQPVVQHARESAAGENALTYALMAGYFKMSPVALYHQLKTGLHPGFGFTVVRQDRFVTENVLFSERASEAYFLGQLQVARHETGGGVNFTLTQPRGNVDLGVGYTAVAATGTVRNPVTDMGNLPQNFYLGRGAPPLLDNAAAVYLRNAVVAGNRLGPAQPLPVFGCAQVPRRAGMDHGQDAVCEFIATPVATDINYFRRPCNPRGRAAGGVYAGDKEGDVIALMYDHGQSDPARPFAATANPWASQRFSYGDLLYNGAYHLNGASPVLSPCFKFFTAADITAKHRCLERLIVETGSAVSTATAASDVQFKRPPGCRELVEDPCGLFQEAYPITCASDPALLRSARDGEAHARETHFTQYLIYDASPLKGLSL

SEQ ID NO: 159 - protein, 722 aa, HSV2; identical to SEQ ID NO: 15

SEQ ID NO: 160 - protein, 318 aa, HSV2; identical to SEQ ID NO: 23

SEQ ID NO: 161 - protein, 825 aa, HSV2
MEPRPGTSSRADPGPERPPRQTPGTQPAAPHAWGMLNDMQWLASSDSEEETEVGISDDDLHRDSTSEAGSTDTEMFEAGLMDAATPPARPPAERQGSPTPADAQGSCGGGPVGEEEAEAGGGGDVCAVCTDEIAPPLRCQSFPCLHPFCIPCMKTWIPLRNTCPLCNTPVAYLIVGVTASGSFSTIPIVNDPRTRVEAEAAVRAGTAVDFIWTGNPRTAPRSLSLGGHTVRALSPTPPWPGTDDEDDDLADVDYVPPAPRRAPRRGGGGAGATRGTSQPAATRPAPPGAPRSSSSGGAPLRAGVGSGSGGGPAVAAVVPRVASLPPAAGGGRAQARRVGEDAAAAEGRTPPARQPRAAQEPPIVISDSPPPSPRRPAGPGPLSFVSSSSAQVSSGPGGGGLPQSSGRAARPRAAVAPRVRSPPRAAAAPVVSASADAAGPAPPAVPVDAHRAPRSRMTQAQTDTQAQSLGRAGATDARGSGGPGAEGGPGVPRGTNTPGAAPHAAEGAAARPRKRRGSDSGPAASSSASSSAAPRSPLAPQGVGAKRAAPRRAPDSDSGDRGHGPLAPASAGAAPPSASPSSQAAVAAASSSSASSSSASSSSASSSSASSSSASSSSASSSSASSSAGGAGGSVASASGAGERRETSLGPRAAAPRGPRKCARKTRHAEGGPEPGARDPAPGLTRYLPIAGVSSVVALAPYVNKTVTGDCLPVLDMETGHIGAYVVLVDQTGNVADLLRAAAPAWSRRTLLPEHARNCVRPPDYPTPPASEWNSLWMTPVGNMLFDQGTLVGALDFHGLRSRHPWSREQGAPAPAGDAPAGHGE

SEQ ID NO: 162 - protein, 15 aa, Artificial Sequence
  Synthetic peptide
IWTGNPRTAPRSLSL

SEQ ID NO: 163 - protein, 15 aa, Artificial Sequence
  Synthetic peptide
YMFFMRPADPSRPST

SEQ ID NO: 164 - protein, 15 aa, Artificial Sequence
  Synthetic peptide
VCRRLGPADRRFVAL

SEQ ID NO: 165 - protein, 15 aa, Artificial Sequence
  Synthetic peptide
GPADRRFVALSGSLE

SEQ ID NO: 166 - protein, 15 aa, Artificial Sequence
  Synthetic peptide
SDVLGHLTRLAHLWE

SEQ ID NO: 167 - protein, 15 aa, Artificial Sequence
  Synthetic peptide
GHMTISTAAQYRNAV

SEQ ID NO: 168 - protein, 15 aa, Artificial Sequence
  Synthetic peptide
LNAWRQRLAHGRVRW

SEQ ID NO: 169 - protein, 15 aa, Artificial Sequence
  Synthetic peptide
QRLAHGRVRWVAECQ

SEQ ID NO: 170 - protein, 15 aa, Artificial Sequence
  Synthetic peptide
DLVAIGDRLVFLEAL

SEQ ID NO: 171 - protein, 15 aa, Artificial Sequence
  Synthetic peptide
GDRLVFLEALERRIY

SEQ ID NO: 172 - protein, 15 aa, Artificial Sequence
  Synthetic peptide
LAYRRRFPAVITRVL

SEQ ID NO: 173 - protein, 15 aa, Artificial Sequence
  Synthetic peptide
RRFPAVITRVLPTRI

SEQ ID NO: 174 - protein, 15 aa, Artificial Sequence
  Synthetic peptide
CAIIHAPAVSGPGPH

SEQ ID NO: 175 - protein, 15 aa, Artificial Sequence
  Synthetic peptide
PNGTRGFAPGALRVD

SEQ ID NO: 176 - protein, 15 aa, Artificial Sequence
  Synthetic peptide
LRVLRAADGPEACYV

SEQ ID NO: 177 - protein, 9 aa, Artificial Sequence
  Synthetic peptide
NPRTAPRSL

SEQ ID NO: 178 - protein, 10 aa, Artificial Sequence
  Synthetic peptide
GPADRRFVAL

SEQ ID NO: 179 - DNA, 2100 bp, HSV-2
atgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattag

SEQ ID NO: 180 - DNA, 471 bp, Homo sapiens
atgcagcatcaccaccatcaccacctgggtctggctgacacggtggtcgcgtgcgtggccctggccgcgtttgacggcgggtcgacggcccccgaggtgggcacgtacacccccctgcgctacgcgtgcgtcctccgcgcgacccagcccctgtacgcgcggaccacccccgccaaattttgggcggacgtgcgcgccgccgcggaacacgtggaccttcgccccgcgtcctcggcgccccgggcgcccgtgagcgggacggcagaccccgccttcctgctcgaagacctggcggccttcccccccgcccccctgaatagcgagtccgtgctggggccgcgggtccgcgtcgtggacatcatggcgcagtttcggaaactgctcatgggcgacgaggagaccgccgccctccgggcgcacgtgtccgggaggcgcgcgaccgggctgggcggcccgccacgcccatagtga

SEQ ID NO: 181 - protein, 155 aa, Homo sapiens
MQHHHHHHLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAALRAHVSGRRATGLGGPPRP

SEQ ID NO: 182 - DNA, 33 bp, Artificial Sequence
  PCR primer
ctgggtctggctgacacggtggtcgcgtgcgtg

SEQ ID NO: 183 - DNA, 31 bp, Artificial Sequence; identical to SEQ ID NO: 109
  PCR primer

SEQ ID NO: 184 - DNA, 957 bp, HSV2; identical to SEQ ID NO: 151

SEQ ID NO: 185 - DNA, 1260 bp, HSV2
atgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttcccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgaggccgggccccggctctgttctatgataaagaccaacaggcctcgggggtgggggcggcttctcgtgcccgccccccctcctcctcctcccttcccccccatccccggcccccctgcgcgggggagctgcatcaaaggccaacaacaaagtgtgtcaaaagcatcacaaaactttattgtaaaatttttataaatataaagttttttttttcctcaagttttcaacaaggccagaaagtccataacaaaatgctggtgtgtgttgctgttcggggccgtgtccgtcccccccccccactcccacccccacttcctgtctcctccccgtctttccccccccccacctccccctgcccccgaggcgcctcggccggtggtccggtggggggcggcttccttcgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtga

SEQ ID NO: 186 - DNA, 1473 bp, HSV2
atggacctgttggtcgacgatctgtttgcggacgcggacggggtttcgccaccgccccccaggccagccgggggtcccaagaacaccccagccgcccctccgctgtacgccaccggtcggctgagtcaggcccagctgatgccctcgccgcccatgcccgtcccccccgcggccctgtttaaccgtctcctcgacgatctgggcttcagcgcgggtcccgcgctgtgtaccatgctagatacctggaacgaggacctgttctctgggttcccgaccaacgccgacatgtaccgggagtgcaagtttctgtcgacgctgcccagcgacgtgatcgactggggggatgcgcacgtccccgagcgctccccgatcgacattcgcgcccacggcgacgtggcgttccccaccctgcccgccacccgcgacgagctgccttcgtactacgaggccatggcgcagtttttccgcggtgagctgcgggcgcgggaggagagctaccggaccgtgttggcaaatttttgctcggccctgtaccggtacctgcgcgccagcgttcggcagctacaccgccaggcacacatgcggggccgcaaccgcgacctgcgggagatgctgcgcaccacgatcgcggacaggtactaccgcgagaccgcgcgcctggcgcgcgtcctgtttctgcatctatacctctttctgagccgcgagatcctatgggccgcgtacgccgagcagatgatgcggcccgatctgttcgacggcctctgctgcgacctggagagctggcgccagttggcgtgtctgtttcagcccctgatgtttatcaacggatcgctcaccgtgcggggagttcccgtggaggcccggcgactgcgggagctaaaccacattcgcgagcacctgaacctcccgctggtgcgaagtgcggcggcggaggaacccggggcgcccctcacgaccccgcccgtcctgcagggcaaccaggcccgctcctctgggtactttatgctgctgatccgggccaagttggactcgtactccagcgtcgcgacctcggagggcgagtccgtcatgcgggagcacgcgtatagccgcgggcggaccagaaacaattacggatcgacaatcgagggcctgctcgacctcccggacgacgatgacgctcctgcggaggccgggctggtggcgccgcgcatgtcgtttctctccgcgggacaacgcccccgcagactgtccaccaccgcccccattaccgacgtcagcctgggagacgaactccgcctggacggcgaggaggtggatatgacgcccgccgacgccctggacgacttcgacttggagatgctgggggacgtggagtccccctccccgggaatgacccacgaccccgtctcgtatggggctttggacgtggacgattttgagtttgaacagatgtttaccgatgccatgggcattgacgactttggggggtag

SEQ ID NO: 187 - DNA, 1479 bp, HSV2
atgggtctgtttggcatgatgaagtttgcccagactcaccatctggtgaagcgccggggcctccgggccccggagggctactttacccccatcgccgtggacctgtggaatgtcatgtataccctggtggttaaatatcagcgccgctacccaagttacgaccgcgaggcaatcacgctacactgtctctgtagtatgttacgggtgtttacccaaaagtccctgttccccatcttcgtgaccgatcgcggggtcgagtgtaccgagccggttgtgttcggggccaaggcgatcctggcccgcacgacggcccagtgccgcacggacgaggaggccagtgacgtagacgcctcgccgccgccttcccccatcaccgactccaggcccagtttcgccttttccaacatgcgccgccgcgggcacgccttcgccccgggggaccggggaacgcgggccgccggcccaggcccggcggccccctcgggcgcgccctcgaagccggccctgcgcctggctcacctgttctgtatccgcgttctgcgggcgctggggtacgcctacatcaactcgggtcagctggaggccgacgacgcctgcgcgaacctctatcataccaacacggtcgcgtacgtgcataccacggataccgatctcctgctgatgggctgcgatatcgtgttggacatcagcaccggctacattccgacgattcactgccgcgacctgctgcagtacttcaagatgagttacccgcagttcctggcgctgttcgtccgctgccacacagacctgcaccccaataacacctacgcgtccgtcgaggacgtgctgcgcgagtgtcactggaccgccccgagccgatcccaggcccgccgggcggcccggcgggagcgcgccaactcgcgctccctggagagcatgcctacgctgaccgcggccccggtcggcctcgagacgcgcatctcgtggaccgaaattctggcccaacagatcgcgggcgaggacgactacgaagaagacccccccctccagcccccggacgtcgccggtgggccgcgcgacggcgcccggtcgtcctcctcggagatactcaccccgcccgagctcgtgcaggtccccaacgcgcagcgggtcgcggaacaccgcggctatgtcgccggacgtcgccgccacgtcatccacgacgccccggaggccctggactggctgcccgatccgatgaccatcgccgagctggtggagcacagatacgtcaagtacgtcatatcgcttatcagccccaaggagcggggaccctggactcttctaaaaagactgcccatctatcaggacctccgcgacgaagatttagcgcgctccatcgtgactcggcatatcaccgccccggacatcgccgaccggtttctggcgcagctgtgggcccacgcgcccccgcccgcgttttacaaggacgtcctggctaaattctgggacgagtag

SEQ ID NO: 188 - DNA, 3429 bp, HSV2; identical to SEQ ID NO: 65

SEQ ID NO: 189 - DNA, 3345 bp, HSV2; identical to SEQ ID NO: 49

SEQ ID NO: 190 - DNA, 9369 bp, HSV2
atgattccggccgcgctacctcaccccacgatgaagcgccagggggatcgcgatatcgtggtcaccggtgttcggaaccagttcgcgaccgatctggagccgggggggtcggtatcgtgcatgcgctcgtccctgtcgtttctcagtcttcttttcgacgtggggccccgcgacgtgctgtccgcggaggccatcgagggatgtctggtggaggggggcgagtggacgcgcgcggccgcgggctccgggccgccgcgcatgtgttccattatcgagctccccaacttcctggagtacccggcggcgcgcggcggcctgcgttgcgtgttttcgcgggtgtacggcgaggtgggcttcttcggggagcccacggcggggctgctggagacgcaatgccccgcgcacacgttcttcgccggcccctgggccatgcggccgctgtcctacacgctcctgaccatcggccccctgggcatggggctctaccgggacggcgacacggcctatctgtttgacccgcacggcctgcccgcgggaacgcccgcgtttatcgccaaggtgcgggcgggcgacgtgtacccgtacctgacgtattacgcccacgaccgccccaaggtgcggtgggcgggcgccatggtgttttttgtgccctccggcccgggggccgtggcgccggcggacctgaccgccgcggccctgcacctctacggggccagcgagacttacctgcaggacgaaccgttcgtcgagcggcgcgtggccatcacccaccccctgcggggcgagatcggggggctcggggcgctctttgtcggtgtggtccccaggggggacggagaaggctcgggcccggtcgtccccgcgctccccgcgcccacccacgtccagacccctggggccgaccggccccccgaggccccccggggggcctcgggcccacccgacacaccgcaggcggggcacccaaaccgcccccccgatgatgtgtgggcagcagccctggaggggaccccgcccgcgaagccctcggccccggacgccgcggcctcgggtccaccgcacgccgccccgcccccgcagacacccgccggggacgcggccgaagaagccgaggacctgcgggtcctggaggtgggggcagtgccggtgggtcgccaccgggcgcgctattctaccggcttgcccaagcgccgccggcccacctggaccccaccgtccagcgtggaggatctgacctcgggcgagaggcccgcccccaaggccccgcccgccaaggccaagaagaagtccgcgcccaagaagaaggcccccgtcgccgccgaggtccccgcctcctccccgacgcccatagccgccacggtccctcccgcaccggatacccccccgcagtccgggcagggcggcggcgacgacgggcccgcgagcccgtcgtcgccgtccgtgctcgagacgctgggggcccgccgccccccggagccccccggcgccgacctggcgcagctgttcgaggtccaccccaatgtggccgccacggcggtccggctcgcggcgcgcgatgccgccctggcccgcgaggtggccgcgtgttcgcagctcaccatcaacgccctgcggtcgccgtacccggcgcacccggggctgttggagctctgcgtcatcttcttctttgagcgcgtcctcgcctttttgatcgagaacggggcccgcacgcatacgcaggccggggtggccggcccggccgcggccctgctggacttcaccctgcgcatgctgccccgcaaaacggccgtcggggacttcctggcgtccacgcgcatgagcctggcggacgtggccgcccaccggcccctcatccagcacgtgctggacgaaaattcgcagatcgggcgcctggccctcgctaagctggtcctggtcgccagggacgttattcgggagacggacgccttttacggggacctcgcggacctggatctgcagctgcgcgccgccccgccggccaatctgtacgcacgcctcggagagtggctcctggagcgctcgcgcgcccacccgaacaccctgttcgcccccgccaccccgacgcacccggagccgcttctccatcggatccaggcgctggcccagtttgcccggggcgaagagatgcgggtcgaggcggaggcccgcgagatgcgcgaggccttagacgccctcgcccgcggggtcgactcggtctcgcagcgcgccgggcccctgaccgtgatgcccgtgcccgccgccccgggcgccggcggcagggccccgtgcccgcccgccctgggccccgaggccatccaggcgcggctggaggacgtgcggatccaggcccgccgggcgatcgagagcgcggtcaaggagtacttccaccggggagccgtatacagcgcgaaggccctgcaggccagcgacagccacgactgtcggtttcacgtggcctcggccgcggtcgtgcccatggtccagttgctggaatcgctaccggcctttgaccaacacacgcgggacgtcgctcagcgcgccgcgctcccccccccgccccccctcgccaccagcccccaggccatcctgctgcgggacctgctccagcggggccagcccctagatgcccccgaggacctggcggcctggctctcggtcctgaccgacgccgcgacccaggggctcatcgaacgcaagcccctggaagagctggcgcgcagcatccacggcatcaacgaccagcaggcgcggcgcagctcggggctggccgaactgcagcgcttcgacgccctcgacgcggcgctcgcgcagcagctggacagcgacgcggccttcgtcccggcgaccggccccgcgccgtacgtcgacgggggcgggctgtcccccgaggccacgcgcatggccgaagacgcgctgcggcaggcgagggccatggaggcggccaagatgacggcggagctcgctccggaggcgcgctcccggcttcgggagcgcgcccacgccctggaggcgatgctcaacgacgcgcgggagcgcgccaaggtggcccacgacgcccgggagaagttcctgcacaaactccaaggggtcctgcggcccctcccggactttgtggggctaaaggcgtgtccggccgtgctggcgaccctgcgggcctccctgcccgcggggtggaccgacctggccgatgccgtccggggcccccccccggaagtcacggcggcgctgcgggcggacctgtgggggctgctggggcagtaccgggaggccctggaacacccgaccccggataccgcgacggctctggccggcctgcatcccgccttcgtggtggtgctgaagaccctgttcgccgacgcccccgagacgccggtcctcgtgcagttcttttccgatcacgcccccacaatcgccaaagccgtgtcaaacgccatcaacgccgggagcgccgccgtcgcgacggcaagtcccgcggcgacggtggacgcggccgtgcgggcgcatggcgccctggcggacgcggtgtcggccctgggcgcggccgcccgcgacccggcctcgcccctgtccttcctcgcggtgctggccgatagcgccgcggggtatgtaaaggcgactcggctggccctggaggcgcggggggccatcgacgagctcacgaccctggggtcggcggccgccgacctggtagtccaggcgcgccgggcctgcgcccagccggagggggaccatgccgccctcatcgatgccgcggcccgcgcgacgaccgctgctcgggaaagcctcgcggggcacgaggctgggttcgggggcctgctgcacgccgaagggacggccggggaccattcccccagcgggcgcgccctgcaggagctgggcaaggtcatcggcgccacgcgacgccgcgccgacgaacttgaggccgccgtcgccgacctgacggcgaagatggcggcccagcgcgcccggggcagcagcgagcgctgggccgccggcgtcgaggcggcgctggaccgcgtcgagaaccgcgccgagttcgacgtggtcgagctgcgccgcctgcaggcgctggcgggcacgcacggctacaacccccgggacttccgcaagcgcgccgagcaggcgctcgcggccaacgccgaggcggtcaccctcgccctggatacggccttcgcgtttaacccctacacccccgagaaccagcgccaccccatgctccccccgctcgccgccatccaccgcctcggctggagcgcggcgttccacgccgccgccgaaacctacgccgacatgtttcgggtcgacgccgagcccctggcgcggctgctgcgcatcgcggaggggctcctggaaatggcccaggcgggcgacgggtttatcgactaccacgaggccgtggggcgcctggcggacgacatgacgagcgtgcccggcctgcgccggtacgtgccgttcttccaacatggctacgccgactacgtggagctccgcgatcgcctggacgccatccgggccgacgtgcaccgggcgctcggcggcgtgcccctggacctggcggccgccgcggagcagatatccgcggcccggaatgacccggaggccaccgcggagctggtccggaccggggtcaccctgccgtgtcccagcgaggacgcgctggtcgcgtgcgcggcggcgttggagcgcgtggaccagagccccgtgaagaacacggcgtacgccgagtatgtcgccttcgtgacccggcaggacacggccgagaccaaggacgcagtggtgcgcgccaaacagcagcgcgcggaggccaccgagcgggtcatggcgggcctgcgggaggcgctggccgcgcgcgagcgccgggcccagatcgaggccgagggcctggccaacctcaagaccatgctgaaggtggtcgccgtcccggcgaccgtggccaagacgctcgaccaggcgcgctcggtggcggagatcgccgaccaggtcgaggttctgttggatcagaccgagaaaacgcgcgagctcgacgtgcccgcggttatctggctagagcacgcccagcgcaccttcgagacgcacccgctaagcgccgcccgcggcgacggccccggccccctggcgcggcacgccggccgcctgggggcgctctttgatactcggcgccgcgtcgacgccctgcggaggtccctggaggaggccgaggcggagtgggacgaggtctggggtcgctttggccgcgtccgggggggcgcctggaagtcccccgaggggttccgcgccatgcacgagcagctgcgcgccctgcaggacaccaccaacacggtgtcggggctgcgggcccagccggcctacgagcgcctttccgccaggtaccagggcgtcctgggcgccaagggcgccgagcgcgcggaggccgtggaggagctgggcgcgcgcgtcaccaagcacaccgccctgtgcgcccggctgcgggatgaggtggtgcgcagggtgccctgggagatgaactttgacgccctggggggcctgctggcggagttcgacgcggcggccgcggacctggccccgtgggcggtggaggagttccggggcgcgcgggaactcatccaataccgcatgggcttatatagcgcgtacgccagggccggcggccagacgggcgcgggcgcggagtccgcgcccgcgcccctgctcgttgatcttcgcgccctcgacgcccgcgcccgggcctcttcttcccccgagggccacgaggtcgacccgcagctgctgcgccgccggggcgaggcgtatctgcgcgccggcggagacccggggcccctggtgctgcgtgaggccgtcagcgctctggatctgccgttcgccaccagctttttggccccggacggaacgccgctgcagtacgcgctatgcttcccggccgtcaccgacaaactcggcgcgctgctgatgcgtcccgaggcggcctgcgtgcggcccccgcttccgacggacgtcctcgaatcggccccgacggtcacggccatgtacgtgctgaccgtcgtgaaccggctccagctggccctcagcgacgcccaggccgccaactttcagctgttcggtcgcttcgtgcgccatcgccaggcgacgtggggcgcctcgatggacgcggcggccgagctgtacgtcgccctcgtcgccaccaccctcacgcgcgagtttgggtgtcgctgggcccagctgggctgggcgtccggagcggcggcgccgcgtccgccgccgggcccccgggggtcccagcgccactgcgtcgccttcaacgagaacgacgtgctggtcgcgctggtggccggcgttccggaacacatctacaacttctggcgcctggacctcgttcgccagcacgagtacatgcacctcaccctcgaacgcgcgttcgaggacgcagcggagtccatgctgttcgtccagcgcctgaccccgcatcccgacgcccgcatccgcgtgttgccgacgtttttggacggaggccccccgacccggggcctcctgttcggcacgcggctggccgactggcgccggggcaagctgtccgaaaccgacccgctggcgccctggcgctcggccttggagctcgggacccagcgccgggacgtcccggcgctcgggaagctcagtccggcccaggccctggcggcggtgagcgtcctcgggcgcatgtgtctgccgagcgccgctttggccgcgctgtggacctgcatgtttcccgacgactacaccgagtacgacagcttcgacgccctcctggccgcacgcctggagtctggccagacgctcggcccggcgggggggcgcgaggcgtccctccccgaggccccccacgccctctaccgacccacgggccagcacgtggccgtgctggccgccgcgacccaccgcacccccgccgcgcgcgttacggccatggacctggttctggccgcggtgctcctcggcgcgcccgtcgtggtggcgctccgcaacaccacggccttctcccgcgagtcggaactggaactgtgcctgacgctcttcgactcgcgccccggcgggccggacgccgccctgcgcgacgtcgtgtcgtccgacatcgagacgtgggccgtcggcctcctccacaccgatctcaacccgatcgaaaacgcgtgtctggcggcgcagctcccgcgcctgtcggcgctcatcgccgagcgccctctcgccgacgggcccccgtgcctggtcctcgtggacatctccatgaccccggtcgcggtcttgtgggaagccccggagccccccggcccccctgacgtgcggtttgtgggcagcgaggccaccgaggagcttccgtttgtggctaccgcgggggacgttctcgcggcgagcgccgccgacgcggaccccttcttcgcgcgggccatcctcgggcggcccttcgacgcctccctcctgacgggggagctgttcccgggacacccggtttaccagcgccccctcgccgacgaggcaggtccctctgccccgaccgccgcccgcgacccgcgggaccttgcggggggggatggcggatcgggtcccgaggaccccgctgccccccccgcacggcaggcggacccgggggtcctcgcccccactctcctcaccgacgccaccaccggcgagcccgtcccccctcgcatgtgggcctggatccacggcctggaggagctggcgtccgacgacgccggcggccccacgcccaatccggccccggcccttcttcccccccccgccaccgatcagtccgtccccacgtcccagtacgcaccgcggcccatcgggccggcagctacggctcgcgaaacacgaccgagtgtcccgcctcaacaaaacacggggcgcgtgcccgtggcccctcgcgacgacccacggccctcgccacccacaccgagtccccccgcggatgccgcgcttcctcccccggccttttccggctctgccgccgctttctccgccgccgtgccgcgcgtgcgcaggtcccgccggacgcgtgccaaatcgcgcgcgccccgggcctccgccccccccgaggggtggcgtccgccggcactccccgccccggtcgccccggtcgccgcttccgcgcgtcctcccgaccagccgcccaccccggagtccgcgcccccggcttgggtttctgctttgccccttccgcccggccccgcctcggctcgcggggcctttcccgcccccacgctcgcgcccatcccgcctccgcccgccgaaggagcggtcgtccccgggggcgaccgccgccgcggccgccgccagacaacagcgggtccctcgccgacacccccccggggccccgcggccggcccaccccggcgcctcacgcgccccgcggtcgcctcgctctcggcctcgttgaactccctcccctctccccgggacccagccgaccacgcggccgcggtttccgccgcagcggcggcagtgccgccttctccgggccttgcccccccgacctccgccgtccagaccagccccccgcctttggccccaggcccggttgccccgagcgagcctttgtgcggttgggtcgtgcccggaggcccggttgcccgccgccccccaccccagtcacccgcgaccaaacccgccgcgcggacgcgcatccgcgcgcgctcggtgccccagccgcccctgccccagccgcccctgccccagccgcccctgccccagccgcccctgccccagccgcccctgccccagccgcccctgccccagccgcccctgccccagccgcccctgccccagccgcccctgccccagccgcccctgccccagccgcccctgccgcccgtaactcggacgcttacaccccagagccgagactcggtcccgacgcccgagtctcccacacatacaaacacccacctcccagtgtccgctgtgacttcgtgggcttcctctctcgcgcttcacgtcgactccgcgcccccacccgcatcgctgcttcagacgctgcacatctcctccgatgatgaacactccgacgcagactccctgcgtttctcggactcggatgataccgaggcgctcgaccccctcccaccggaaccgcacttgccccccgccgacgaaccacccggcccattggccgccgaccacctccagtcaccacactcgcaatttggccccttgcccgtacaggcaaatgccgtcttgtcgcgacgctacgtacgaagcaccggtcgtagcgccctggcggttttgatccgcgcatgccgccgcatacaacaacagctgcagcggacccgcagggcgctgtttcagcgcagcaacgccgtgctgaccagcctacatcacgtgcgcatgttactgggttag

SEQ ID NO: 191 - DNA, 3591 bp, HSV2
atggacaccaagcccaaaacgacgaccaccgtcaaggttcctccggggccgatggggtacgtgtatggccgcgcctgtccggccgaaggcctggagctgctgtcgctactgtcggcgcgcagcggcgacgcggacgtcgccgtcgcgcccctcatcgtcggcctgaccgtggagagcgggtttgaggccaacgtggccgcggtcgtcgggtcccgcacgacgggccttggggggaccgcggtgtccctcaagcttatgccctcgcactacagcccgtccgtttacgtctttcacggcggccgccacctggcccccagcacccaggcccccaacctgacgcggctctgcgagcgggcgcgcccgcattttggcttcgcggactacgcgccccggccctgcgacctaaagcacgagacgacgggggacgcgctgtgcgagcggctcggactggacccggaccgggccttgctgtatctggtgatcacggagggcttccgggaggccgtgtgcatcagcaacaccttcctgcatctgggcgggatggacaaggtaaccatcggggacgcggaggttcaccgcatccccgtgtatccgctgcagatgtttatgccggattttagccgggtcatcgccgatccgtttaactgcaaccaccgatcgatcggggagaatttcaactacccccttccgtttttcaaccgccccctcgcccgcctgctgttcgaggcggtcgtcgggcccgccgccgtggccctgcgtgcccggaacgtggacgccgtggcccgcgcggccgcccacctggcgttcgacgaaaaccacgagggcgcggccctccccgccgacattacgttcacggccttcgaggccagccagggtaagccccagcggggcgcgcgcgacgccgggaacaagggcccggcgggcgggtttgagcagcgcctggcctcggtgatggcgggcgacgccgccctggccctggagtccatcgtgtcgatggcggtctttgacgagccgccccccgacatcaccacgtggcccctgcttgagggccaggaaacgcccgcggcccgcgccggcgccgtcggggcgtacctggcgcgcgccgcgggcctcgtgggcgccatggtgttcagcaccaattcggccctccacctgaccgaggtggacgacgccgggccggcggaccccaaggaccacagcaagccctccttttaccgcttctttctcgtgcccggcacgcacgtggcggccaacccgcagctggaccgcgagggccacgtggtgcccgggtacgaggggcgccccacggcgcccctcgtcggcggaacccaggagttcgccggcgagcacctggccatgctgtgcgggttctctccggccctgctggccaagatgctgttttacctggagcgctgcgacggcggagtcatcgtcgggcgccaggagatggacgtgtttcgctacgtcgcggactcgggccagaccgacgtgccctgcaacctgtgtaccttcgagacccgccacgcctgcgcgcacacgacgctgatgcggctgcgggcccgccaccccaagttcgcgagcgccgcccggggggccattggggtcttcggaacgatgaacagcgcgtacagcgactgcgacgtgctggggaactacgccgccttctcggccctgaagcgcgcggacgggtccgagaacacccggaccatcatgcaggagacgtaccgcgcggccaccgagcgcgtcatggccgagctcgaggccctgcagtacgtggaccaggcggtgcccacggccctggggaggctggagacgattatcggcaaccgcgaggccctgcacacggtggtgaacaacatcaagcagctggtggatcgcgaggtggaacagctgatgcgcaacctgatcgaggggcgcaactttaagttccgcgacggtctggccgaggccaaccacgccatgtcgctgtcgctggacccgtacacctgcgggccgtgccccctgctgcagctcctcgcgcggcggtccaacctcgccgtgtaccaggacctggccctgagccagtgccacggggtgttcgccgggcagtcggtcgaggggcgcaactttcgcaatcaattccaaccggtgctgcggcggcgcgtcatggacctgttcaacaacgggttcctgtcggcgaagacgctgacggtcgcgctctcggagggggcggctatctgcgcccccagcctaacggccggccagacggcccccgccgagagcagcttcgagggcgacgttgcccgcgtgacccttgggtttcccaaggaactgcgcgtcaagagccgcgtgttgttcgcgggcgcgagcgccaacgcgtccgaggccgccaaggcgcgggtcgccagcctccagagcgcctaccagaagcccgacaagcgcgtggacatcctcctcggaccgctgggcttcctgctgaagcagttccacgcggtcatctttcccaacggcaagcccccggggtcgaaccagccgaacccgcagtggttctggaccgccctccagcgcaaccagctccccgcccggctcttgtcgcgcgaggacatagagaccatcgcgttcattaagaggttctccctggactacggcgcgattaactttatcaacctggcccccaataacgtgagcgaactggccatgtactacatggccaaccagatcttgaggtactgcgaccactcgacgtacttcataaacaccctcacggccgtcatcgccgggtcccgccgtccccccagcgtgcaggcggcggccgcctgggccccgcagggcggcgcgggcctggaggccggggcccgcgcgctgatggactccctcgacgcgcaccccggcgcctggacgtccatgttcgcgagctgcaacctgctgcggcccgtgatggccgcgcgcccgatggtcgtgctgggcctcagcatcagcaaatactacggcatggccggcaacgaccgcgtgtttcaggccgggaactgggccagcctgctgggcggcaaaaacgcgtgcccgctgctgatctttgaccgcacccgcaagtttgtcctggcctgccccagggccgggtttgtgtgcgcggcgtcgagtctcgggggcggggcccacgagcattcgctgtgcgagcagctccggggcatcattgcggagggcggggcggcggtcgccagcagcgtgtttgtggcgaccgtcaagagcctgggcccccgcacccagcagctgcagatcgaggactggctggcgctgctggaggacgagtacctgagcgaggaaatgatggagtttaccacccgcgccctggagcgcgggcatggcgagtggtcgaccgacgcggccctggaggtggcccacgaggcggaggccctggtcagccagctcggcgccgccggggaggtgtttaactttggggatttcggcgacgaggatgaccacgcggcgtcgttcggcggtttggcggcggcggcgggggcggccggcgtcgcccgaaagcgggcgtttcacggcgacgatccgtttggggagggaccaccggagaaaaaggacctgacgttggatatgctctag

SEQ ID NO: 192 - DNA, 1758 bp, HSV2
atggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacaggggcctgggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctag

SEQ ID NO: 193 - DNA, 3957 bp, HSV2
atgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcgcaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtga

SEQ ID NO: 194 - DNA, 1242 bp, HSV2
atggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggccagtcttccggggatcgcgcacgcgcaccggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatga

SEQ ID NO: 195 - protein, 318 aa, HSV2; identical to SEQ ID NO: 23

SEQ ID NO: 196 - protein, 413 aa, HSV2
MADIPPDPPALNTTPANHAPPSPPPGSRKRRRPVLPSSSESEGKPDTESESSSTESSEDEAGDLRGGRRRSPRELGGRYFLDLSAESTTGTESEGTGPSDDDDDDASDGWLVDTPPRKSKRPRINLRLTSSPDRRAGVVFPEVWRSDRPIRAAQPQAPASLPGIAHAHRRSARQAQMRSGAAWTLDLHYIRQCVNQLFRILRAAPNPPGSANRLRHLVRDCYLMGYCRTRLGPRTWGRLLQISGGTWDVRLRNAIREVEAHFEPAAEPVCELPCLNARRYGPECDVGNLETNGGSTSDDEISDATDSDDTLASHSDTEGGPSPAGRENPESASGGAIAARLECEFGTFDWTSEEGSQPWLSAVVADTSSAERSGLPAPGACRATEAPEREDGCRKMRFPAACPYPCGHTFLRP

SEQ ID NO: 197 - protein, 1318 aa, HSV2
MSAEQRKKKKTTTTTQGRGAEVAMADEDGGRLRAAAETTGGPGSPDPADGPPPTPNPDRRPAARPGFGWHGGPEENEDEADDAAADADADEAAPASGEAVDEPAADGVVSPRQLALLASMVDEAVRTIPSPPPERDGAQEEAARSPSPPRTPSMRADYGEENDDDDDDDDDDDRDAGRWVRGPETTSAVRGAYPDPMASLSPRPPAPRRHHHHHHHRRRRAPRRRSAASDSSKSGSSSSASSASSSASSSSSASASSSDDDDDDDAARAPASAADHAAGGTLGADDEEAGVPARAPGAAPRPSPPRAEPAPARTPAATAGRLERRRARAAVAGRDATGRFTAGRPRRVELDADAASGAFYARYRDGYVSGEPWPGAGPPPPGRVLYGGLGDSRPGLWGAPEAEEARARFEASGAPAPVWAPELGDAAQQYALITRLLYTPDAEAMGWLQNPRVAPGDVALDQACFRISGAARNSSSFISGSVARAVPHLGYAMAAGRFGWGLAHVAAAVAMSRRYDRAQKGFLLTSLRRAYAPLLARENAALTGARTPDDGGDANRHDGDDARGKPAAAAAPLPSAAASPADERAVPAGYGAAGVLAALGRLSAAPASAPAGADDDDDDDGAGGGGGGRRAEAGRVAVECLAACRGILEALAEGFDGDLAAVPGLAGARPAAPPRPGPAGAAAPPHADAPRLRAWLRELRFVRDALVLMRLRGDLRVAGGSEAAVAAVRAVSLVAGALGPALPRSPRLLSSAAAAAADLLFQNQSLRPLLADTVAAADSLAAPASAPREARKRKSPAPARAPPGGAPRPPKKSRADAPRPAAAPPAGAAPPAPPTPPPRPPRPAALTRRPAEGPDPQGGWRRQPPGPSHTPAPSAAALEAYCAPRAVAELTDHPLFPAPWRPALMFDPRALASLAARCAAPPPGGAPAAFGPLRASGPLRRAAAWMRQVPDPEDVRVVILYSPLPGEDLAAGRAGGGPPPEWSAERGGLSCLLAALGNRLCGPATAAWAGNWTGAPDVSALGAQGVLLLSTRDLAFAGAVEFLGLLAGACDRRLIVVNAVRAADWPADGPVVSRQHAYLACEVLPAVQCAVRWPAARDLRRTVLASGRVFGPGVFARVEAAHARLYPDAPPLRLCRGANVRYRVRTRFGPDTLVPMSPREYRRAVLPALDGRAAASGAGDAMAPGAPDFCEDEAHSHRACARWGLGAPLRPVYVALGRDAVRGGPAELRGPRREFCARALLEPDGDAPPLVLRDDADAGPPPQIRWASAAGRAGTVLAAAGGGVEVVGTAAGLATPPRREPVDMDAELEDDDDGLFGE

SEQ ID NO: 198 - protein, 419 aa, HSV2
MPRVSSSCSSSFLPARVRRGGRGGQVCGRGGRRGGGGHGRKCGCMPRVFSSPSSFLPPVPGGRGRACVVIQPPSPPPHFPPSLSKFPGPWLRAGGAADPPPPPSPSQAPSHSCPPPPGSGRPDVRALHDRAPLPVNTDTLFFYPPASPPTHQDREPERGRAPALFYDKDQQASGVGAASRARPPSSSSLPPHPRPPCAGELHQRPTTKCVKSITKLYCKIFINIKFFFSSSFQQGQKVHNKMLVCVAVRGRVRPPPPLPPPLPVSSPSFPPPTSPCPRGASAGGPVGGGFLRAASRVLAPPTPRGPRGRRRPARARPAPETTGGATGGRGSPARPPGCPGQRACCPPGSSRGCSTPTRGASGSRGASRSCARARGAGCGGSTRGPRPAAGPPRSPSGPRGPRRPLCGPSPCPGRAGSPP

SEQ ID NO: 199 - protein, 585 aa, HSV2
MDPYYPFDALDVWEHRRFIVADSRSFITPEFPRDFWMLPVFNIPRETAAERAAVLQAQRTAAAAALENAALQAAELPVDIERRIRPIEQQVHHIADALEALETAAAAAEEADAARDAEARGEGAADGAAPSPTAGPAAAEMEVQIVRNDPPLRYDTNLPVDLLHMVYAGRGAAGSSGVVFGTWYRTIQERTIADFPLTTRSADFRDGRMSKTFMTALVLSLQSCGRLYVGQRHYSAFECAVLCLYLLYRTTHESSPDRDRAPVAFGDLLARLPRYLARLAAVIGDESGRPQYRYRDDKLPKAQFAAAGGRYEHGALATHVVIATLVRHGVLPAAPGDVPRDTSTRVNPDDVAHRDDVNRAAAAFLARGHNLFLWEDQTLLRATANTITALAVLRRLLANGNVYADRLDNRLQLGMLIPGAVPAEAIARGASGLDSGAIKSGDNNLEALCVNYVLPLYQADPTVELTQLFPGLAALCLDAQAGRPLASTRRVVDMSSGARQAALVRLTALELINRTRTNTTPVGEIINAHDALGIQYEQGPGLLAQQARIGLASNTKRFATFNVGSDYDLLYFLCLGFIPQYLSVA

SEQ ID NO: 200 - protein, 1196 aa, HSV2
MDTKPKTTTTVKVPPGPMGYVYGRACPAEGLELLSLLSARSGDADVAVAPLIVGLTVESGFEANVAAVVGSRTTGLGGTAVSLKLMPSHYSPSVYVFHGGRHLAPSTQAPNLTRLCERARPHFGFADYAPRPCDLKHETTGDALCERLGLDPDRALLYLVITEGFREAVCISNTFLHLGGMDKVTIGDAEVHRIPVYPLQMFMPDFSRVIADPFNCNHRSIGENFNYPLPFFNRPLARLLFEAVVGPAAVALRARNVDAVARAAAHLAFDENHEGAALPADITFTAFEASQGKPQRGARDAGNKGPAGGFEQRLASVMAGDAALALESIVSMAVFDEPPPDITTWPLLEGQETPAARAGAVGAYLARAAGLVGAMVFSTNSALHLTEVDDAGPADPKDHSKPSFYRFFLVPGTHVAANPQLDREGHVVPGYEGRPTAPLVGGTQEFAGEHLAMLCGFSPALLAKMLFYLERCDGGVIVGRQEMDVFRYVADSGQTDVPCNLCTFETRHACAHTTLMRLRARHPKFASAARGAIGVFGTMNSAYSDCDVLGNYAAFSALKRADGSENTRTIMQETYRAATERVMAELEALQYVDQAVPTALGRLETIIGNREALHTVVNNIKQLVDREVEQLMRNLIEGRNFKFRDGLAEANHAMSLSLDPYTCGPCPLLQLLARRSNLAVYQDLALSQCHGVFAGQSVEGRNFRNQFQPVLRRRVMDLFNNGFLSAKTLTVALSEGAAICAPSLTAGQTAPAESSFEGDVARVTLGFPKELRVKSRVLFAGASANASEAAKARVASLQSAYQKPDKRVDILLGPLGFLLKQFHAVIFPNGKPPGSNQPNPQWFWTALQRNQLPARLLSREDIETIAFIKRFSLDYGAINFINLAPNNVSELAMYYMANQILRYCDHSTYFINTLTAVIAGSRRPPSVQAAAAWAPQGGAGLEAGARALMDSLDAHPGAWTSMFASCNLLRPVMAARPMVVLGLSISKYYGMAGNDRVFQAGNWASLLGGKNACPLLIFDRTRKFVLACPRAGFVCAASSLGGGAHEHSLCEQLRGIIAEGGAAVASSVFVATVKSLGPRTQQLQIEDWLALLEDEYLSEEMMEFTTRALERGHGEWSTDAALEVAHEAEALVSQLGAAGEVFNFGDFGDEDDHAASFGGLAAAAGAAGVARKRAFHGDDPFGEGPPEKKDLTLDML

SEQ ID NO: 201 - protein, 3122 aa, HSV2
MIPAALPHPTMKRQGDRDIVVTGVRNQFATDLEPGGSVSCMRSSLSFLSLLFDVGPRDVLSAEAIEGCLVEGGEWTRAAAGSGPPRMCSIIELPNFLEYPAARGGLRCVFSRVYGEVGFFGEPTAGLLETQCPAHTFFAGPWAMRPLSYTLLTIGPLGMGLYRDGDTAYLFDPHGLPAGTPAFIAKVRAGDVYPYLTYYAHDRPKVRWAGAMVFFVPSGPGAVAPADLTAAALHLYGASETYLQDEPFVERRVAITHPLRGEIGGLGALFVGVVPRGDGEGSGPVVPALPAPTHVQTPGADRPPEAPRGASGPPDTPQAGHPNRPPDDVWAAALEGTPPAKPSAPDAAASGPPHAAPPPQTPAGDAAEEAEDLRVLEVGAVPVGRHRARYSTGLPKRRRPTWTPPSSVEDLTSGERPAPKAPPAKAKKKSAPKKKAPVAAEVPASSPTPIAATVPPAPDTPPQSGQGGGDDGPASPSSPSVLETLGARRPPEPPGADLAQLFEVHPNVAATAVRLAARDAALAREVAACSQLTINALRSPYPAHPGLLELCVIFFFERVLAFLIENGARTHTQAGVAGPAAALLDFTLRMLPRKTAVGDFLASTRMSLADVAAHRPLIQHVLDENSQIGRLALAKLVLVARDVIRETDAFYGDLADLDLQLRAAPPANLYARLGEWLLERSRAHPNTLFAPATPTHPEPLLHRIQALAQFARGEEMRVEAEAREMREALDALARGVDSVSQRAGPLTVMPVPAAPGAGGRAPCPPALGPEAIQARLEDVRIQARRAIESAVKEYFHRGAVYSAKALQASDSHDCRFHVASAAVVPMVQLLESLPAFDQHTRDVAQRAALPPPPPLATSPQAILLRDLLQRGQPLDAPEDLAAWLSVLTDAATQGLIERKPLEELARSIHGINDQQARRSSGLAELQRFDALDAALAQQLDSDAAFVPATGPAPYVDGGGLSPEATRMAEDALRQARAMEAAKMTAELAPEARSRLRERAHALEAMLNDARERAKVAHDAREKFLHKLQGVLRPLPDFVGLKACPAVLATLRASLPAGWTDLADAVRGPPPEVTAALRADLWGLLGQYREALEHPTPDTATALAGLHPAFVVVLKTLFADAPETPVLVQFFSDHAPTIAKAVSNAINAGSAAVATASPAATVDAAVRAHGALADAVSALGAAARDPASPLSFLAVLADSAAGYVKATRLALEARGAIDELTTLGSAAADLVVQARRACAQPEGDHAALIDAAARATTAARESLAGHEAGFGGLLHAEGTAGDHSPSGRALQELGKVIGATRRRADELEAAVADLTAKMAAQRARGSSERWAAGVEAALDRVENRAEFDVVELRRLQALAGTHGYNPRDFRKRAEQALAANAEAVTLALDTAFAFNPYTPENQRHPMLPPLAAIHRLGWSAAFHAAAETYADMFRVDAEPLARLLRIAEGLLEMAQAGDGFIDYHEAVGRLADDMTSVPGLRRYVPFFQHGYADYVELRDRLDAIRADVHRALGGVPLDLAAAAEQISAARNDPEATAELVRTGVTLPCPSEDALVACAAALERVDQSPVKNTAYAEYVAFVTRQDTAETKDAVVRAKQQRAEATERVMAGLREALAARERRAQIEAEGLANLKTMLKVVAVPATVAKTLDQARSVAEIADQVEVLLDQTEKTRELDVPAVIWLEHAQRTFETHPLSAARGDGPGPLARHAGRLGALFDTRRRVDALRRSLEEAEAEWDEVWGRFGRVRGGAWKSPEGFRAMHEQLRALQDTTNTVSGLRAQPAYERLSARYQGVLGAKGAERAEAVEELGARVTKHTALCARLRDEVVRRVPWEMNFDALGGLLAEFDAAAADLAPWAVEEFRGARELIQYRMGLYSAYARAGGQTGAGAESAPAPLLVDLRALDARARASSSPEGHEVDPQLLRRRGEAYLRAGGDPGPLVLREAVSALDLPFATSFLAPDGTPLQYALCFPAVTDKLGALLMRPEAACVRPPLPTDVLESAPTVTAMYVLTVVNRLQLALSDAQAANFQLFGRFVRHRQATWGASMDAAAELYVALVATTLTREFGCRWAQLGWASGAAAPRPPPGPRGSQRHCVAFNENDVLVALVAGVPEHIYNFWRLDLVRQHEYMHLTLERAFEDAAESMLFVQRLTPHPDARIRVLPTFLDGGPPTRGLLFGTRLADWRRGKLSETDPLAPWRSALELGTQRRDVPALGKLSPAQALAAVSVLGRMCLPSAALAALWTCMFPDDYTEYDSFDALLAARLESGQTLGPAGGREASLPEAPHALYRPTGQHVAVLAAATHRTPAARVTAMDLVLAAVLLGAPVVVALRNTTAFSRESELELCLTLFDSRPGGPDAALRDVVSSDIETWAVGLLHTDLNPIENACLAAQLPRLSALIAERPLADGPPCLVLVDISMTPVAVLWEAPEPPGPPDVRFVGSEATEELPFVATAGDVLAASAADADPFFARAILGRPFDASLLTGELFPGHPVYQRPLADEAGPSAPTAARDPRDLAGGDGGSGPEDPAAPPARQADPGVLAPTLLTDATTGEPVPPRMWAWIHGLEELASDDAGGPTPNPAPALLPPPATDQSVPTSQYAPRPIGPAATARETRPSVPPQQNTGRVPVAPRDDPRPSPPTPSPPADAALPPPAFSGSAAAFSAAVPRVRRSRRTRAKSRAPRASAPPEGWRPPALPAPVAPVAASARPPDQPPTPESAPPAWVSALPLPPGPASARGAFPAPTLAPIPPPPAEGAVVPGGDRRRGRRQTTAGPSPTPPRGPAAGPPRRLTRPAVASLSASLNSLPSPRDPADHAAAVSAAAAAVPPSPGLAPPTSAVQTSPPPLAPGPVAPSEPLCGWVVPGGPVARRPPPQSPATKPAARTRIRARSVPQPPLPQPPLPQPPLPQPPLPQPPLPQPPLPQPPLPQPPLPQPPLPQPPLPQPPLPPVTRTLTPQSRDSVPTPESPTHTNTHLPVSAVTSWASSLALHVDSAPPPASLLQTLHISSDDEHSDADSLRFSDSDDTEALDPLPPEPHLPPADEPPGPLAADHLQSPHSQFGPLPVQANAVLSRRYVRSTGRSALAVLIRACRRIQQQLQRTRRALFQRSNAVLTSLHHVRMLLG

SEQ ID NO: 202 - protein, 1114 aa, HSV2
MSDSALQVPAPAGMTPPSAPPPNGPLQVLLGSLTNLRRPPSPSSEPAGSADEPAFLSAAKLHAATAAFLLSGAAVGPAEARACWHPLLEQLCALHRAHGLPETALLAENLPGLLVHRMAVALPETPEAAFREMDVIKDTVLAITGSDTTHALEAAGLRTTAALGPVRVRQCAVEWIDRWRTVTQSCLAMNPRTSLEALGEMSLKMSPVPLGQPGANLTTPAYSLLFPSPIVQEGLRFLALVSNWVTLFSAHLQRIDDAALTPLTRALFTLALVDDYLTTPDRGAVVPPPLLAQFQHTVREIDPAIMIPPLEATKMVRSREEVRVSTALSRVSPRSACAPPGTLMARVRTDAAVFDPDVPFLSASALAIFRPAVTGLLQLGEPPSAGAQQRLLALLQQTWALVQNSNSPSVVINTLTDAGFTPAHCTQYISALEGFLVAGVPARTPPGHGLSEIQQLFGCIALAGANVFGLAREYGHYAGYVKTFRRIQGASEHTHGRLCEAVGLSGGVLSQTLARIMGPAVPTEHLASLRRTLVGEFETAERRFSAGQPSLLRETALIWLDVYGQTHWDLTPTTPATPLSALLPVGPPSHAPSVHLAAATKIRFPALEGIHPNVLADPGFVPYVLALVVGDALRATCNAAYLPRPIEFALRVLAWARDFGLGYLPTVEGHRTKLGALITLLEPATRAGVGPTMQMADNIEQLLRELYVIARGAVEQLRPAVQLPPPQPPEVGSSLLLISMYALAARGVLQELAERADPLVRQLEDAIVLLRLHMRTLAAFFECRFESDGHRLYAVVADAHERLGPWRPEAMGDAVSQYCGMYHDAKRALVASLAGLRSVVTETTAHLGVCDELAAQVSHEGNVLAVVRREIHGFLAIVSGIHARASKLMSGDQVPGFCYMSQFLARWRRLSAGYQAARAATGPERVAEFVQELHDTWKGLQTERALVVARFASSADQRTAAIQEVMAHATEDAPPSPAADLVVLTNRHDLGAWGDYSLGPLGQPTVVPDSVDLSPQGLAATLSMDWLLINELLQVTDGVFRASAFRPSAGPGAPGDLEAQDAGGSTPEPTTPGPQDTQARAPSTRPAGRETVPWPNTPVEDDEMTPQETPPVHP

SEQ ID NO: 203 - protein, 1142 aa, HSV2; identical to SEQ ID NO: 3

SEQ ID NO: 204 - protein, 492 aa, HSV2
MGLFGMMKFAQTHHLVKRRGLRAPEGYFTPIAVDLWNVMYTLVVKYQRRYPSYDREAITLHCLCSMLRVFTQKSLFPIFVTDRGVECTEPVVFGAKAILARTTAQCRTDEEASDVDASPPPSPITDSRPSFAFSNMRRRGHAFAPGDRGTRAAGPGPAAPSGAPSKPALRLAHLFCIRVLRALGYAYINSGQLEADDACANLYHTNTVAYVHTTDTDLLLMGCDIVLDISTGYIPTIHCRDLLQYFKMSYPQFLALFVRCHTDLHPNNTYASVEDVLRECHWTAPSRSQARRAARRERANSRSLESMPTLTAAPVGLETRISWTEILAQQIAGEDDYEEDPPLQPPDVAGGPRDGARSSSSEILTPPELVQVPNAQRVAEHRGYVAGRRRHVIHDAPEALDWLPDPMTIAELVEHRYVKYVISLISPKERGPWTLLKRLPIYQDLRDEDLARSIVTRHITAPDIADRFLAQLWAHAPPPAFYKDVLAKFWDE

SEQ ID NO: 205 - protein, 490 aa, HSV2
MDLLVDDLFADADGVSPPPPRPAGGPKNTPAAPPLYATGRLSQAQLMPSPPMPVPPAALFNRLLDDLGFSAGPALCTMLDTWNEDLFSGFPTNADMYRECKFLSTLPSDVIDWGDAHVPERSPIDIRAHGDVAFPTLPATRDELPSYYEAMAQFFRGELRAREESYRTVLANFCSALYRYLRASVRQLHRQAHMRGRNRDLREMLRTTIADRYYRETARLARVLFLHLYLFLSREILWAAYAEQMMRPDLFDGLCCDLESWRQLACLFQPLMFINGSLTVRGVPVEARRLRELNHIREHLNLPLVRSAAAEEPGAPLTTPPVLQGNQARSSGYFMLLIRAKLDSYSSVATSEGESVMREHAYSRGRTRNNYGSTIEGLLDLPDDDDAPAEAGLVAPRMSFLSAGQRPRRLSTTAPITDVSLGDELRLDGEEVDMTPADALDDFDLEMLGDVESPSPGMTHDPVSYGALDVDDFEFEQMFTDAMGIDDFGG

SEQ ID NO: 206 - DNA, 1443 bp, HSV-2
cccggccctgggggccaactacttctcctccatccgccagcccgtggtgcagcacgcccgcgagagcgcggcgggggagaacgcgctgacctacgcgctcatggcggggtacttcaagatgagccccgtggccctgtatcaccagctcaagacgggcctccaccccgggttcgggttcaccgtcgtgcggcaggaccgcttcgtgaccgagaacgtgctgttttccgagcgcgcgtcggaggcgtactttctgggccagctccaggtggcccgccacgaaacgggcgggggggtcagcttcacgctcacccagccgcgcggaaacgtggacctgggtgtgggctacaccgccgtcgcggccacggccaccgtccgcaaccccgttacggacatgggcaacctcccccaaaacttttacctcggccgcggggcccccccgctgctagacaacgcggccgccgtgtacctgcgcaacgcggtcgtggcgggaaaccggctggggccggcccagcccctcccggtctttggctgcgcccaggtgccgcggcgcgccggcatggaccacgggcaggatgccgtgtgtgagttcatcgccacccccgtggccacggacatcaactactttcgccggccctgcaacccgcggggacgcgcggccggcggcgtgtacgcgggggacaaggagggggacgtcatagccctcatgtacgaccacggccagagcgacccggcgcggcccttcgcggccacggccaacccgtgggcgtcgcagcggttctcgtacggggacctgctgtacaacggggcctatcacctcaacggggcctcgcccgtcctcagcccctgcttcaagttcttcaccgcggccgacatcacggccaaacatcgctgcctggagcgtcttatcgtggaaacgggatcggcggtatccacggccaccgctgccagcgacgtgcagtttaagcgcccgccggggtgccgcgagctcgtggaagacccgtgcggcctgtttcaggaagcctacccgatcacctgcgccagcgaccccgccctgctacgcagcgcccgcgatggggaggcccacgcgcgagagacccactttacgcagtatctcatctacgacgcctccccgctaaagggcctgtctctgtaaaattggcttcttcttccccagctttccctccacccgcccgtctttttttttttttttttttttctgtttggggcattgggtttgattttccgacgttgcttttacccacacacaccccctgtccccgcccccccgggggggcttggactgggagccgcgattccgagggcaggtcccaataaaacccagacccgagctccgggggactgattcttacctggggctcctgcgcacgacagacctccccgtgcgtgctgctgagccctgccccgccccctctcccacacggt

SEQ ID NO: 207 - DNA, 1313 bp, HSV-2
  misc_feature 338: n = A,T,C or G
gcgaaacaatccgtgatcatggcgccgggccgcgagacaccggaacgcgggggtgcgggagggccggaaagcgcaacgcaaccgggacgatgacgaaacagagatggggggcaccgaccgtgtgggagagggggcggggcagggctcagcagcacgcacggggaggtctgtcgtgcgcaggagccccaggtaagaatcagtcccccggagctcgggtctgggttttattgggacctgccctcggaatcgcggctcccagtccaagcccccccgggggggcggggacagggggtgtgtgtgggtaaaagcaacgtcggaaaatcaaacccaatgccccnaacagaaaaaaaaaaaaaaaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagctgacccccccgcccgtttcgtggcgggccacctggagctggcccagaa

SEQ ID NO: 208 - DNA, 1251 bp, HSV-2
ggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagctgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccatt

SEQ ID NO: 209 - DNA, 881 bp, HSV-2
ttctgggccagctccaggtggcccgccacgaaacgggcgggggggtcagcttcacgctcacccagccgcgcggaaacgtggacctgggtgtgggctacaccgccgtcgcggccacggccaccgtccgcaaccccgttacggacatgggcaacctcccccaaaacttttacctcggccgcggggcccccccgctgctagacaacgcggccgccgtgtacctgcgcaacgcggtcgtggcgggaaaccggctggggccggcccagcccctcccggtctttggctgcgcccaggtgccgcggcgcgccggcatggaccacgggcaggatgccgtgtgtgagttcatcgccacccccgtggccacggacatcaactactttcgccggccctgcaacccgcggggacgcgcggccggcggcgtgtacgcgggggacaaggagggggacgtcatagccctcatgtacgaccacggccagagcgacccggcgcggcccttcgcggccacggccaacccgtgggcgtcgcagcggttctcgtacggggacctgctgtacaacggggcctatcacctcaacggggcctcgcccgtcctcagcccctgcttcaagttcttcaccgcggccgacatcacggccaaacatcgctgcctggagcgtcttatcgtggaaacgggatcggcggtatccacggccaccgctgccagcgacgtgcagtttaagcgcccgccggggtgccgcgagctcgtggaagacccgtgcggcctgtttcaggaagcctacccgatcacctgcgccagcgaccccgccctgctacgcagcgcccgcgatggggaggcccacgcgcgagagacccactttacgcagtatctcatctacgacgcctcc

SEQ ID NO: 210 - DNA, 4125 bp, HSV-2; identical to SEQ ID NO: 76

SEQ ID NO: 211 - protein, 293 aa, HSV-2
LGQLQVARHETGGGVSFTLTQPRGNVDLGVGYTAVAATATVRNPVTDMGNLPQNFYLGRGAPPLLDNAAAVYLRNAVVAGNRLGPAQPLPVFGCAQVPRRAGMDHGQDAVCEFIATPVATDINYFRRPCNPRGRAAGGVYAGDKEGDVIALMYDHGQSDPARPFAATANPWASQRFSYGDLLYNGAYHLNGASPVLSPCFKFFTAADITAKHRCLERLIVETGSAVSTATAASDVQFKRPPGCRELVEDPCGLFQEAYPITCASDPALLRSARDGEAHARETHFTQYLIYDAS

SEQ ID NO: 212 - protein, 1374 aa, HSV-2; identical to SEQ ID NO: 158

SEQ ID NO: 213 - DNA, 1644 bp, Herpes Simplex Virus Type 2
gctcgcggggccgggttggtgttttttgttggagtttgggtcgtatcgtgcctggcggcagcacccagaacgtcctggaaacgggtaacctcgggcgaggacgtggtgttgcttccggcgcccgcggggccggaggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggagcagcacctcccccagcgccagcccgagcccgtcgagcccacccgcccgcacgtgagagccccccctcccgcgccctccgcgcgcggcccgctgcgcctcggggcgatgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaa

SEQ ID NO: 214 - DNA, 1644 bp, Herpes Simplex Virus Type 2
gctcgcggggccgggttggtgttttttgttggagtttgggtcgtatcgtgcctggcggcagcacccagaacgtcctggaaacgggtaacctcgggcgaggacgtggtgttgcttccggcgcccgcggggccggaggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccgcaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgcggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaa

SEQ ID NO: 215 - protein, 547 aa, Herpes Simplex Virus Type 2
ARGAGLVFFVGVWVVSCLAAAPRTSWKRVTSGEDVVLLPAPAGPEERTRAHKLLWAAEPLDACGPLRPSWVALWPPRRVLETVVDAACMRAPEPLAIAYSPPFPAGDEGLYSELAWRDRVAVVNESLVIYGALETDSGLYTLSVVGLSDEARQVASVVLVVEPAPVPTPTPDDYDEEDDAGVSERTPVSVPPPTPPRRPPVAPPTHPRVIPEVSHVRGVTVHMETPEAILFAPGETFGTNVSIHAIAHDDGPYAMDVVWMRFDVPSSCAEMRIYEACLYHPQLPECLSPADAPCAVSSWAYRLAVRSYAGCSRTTPPPRCFAEARMEPVPGLAWLASTVNLEFQHASPQHAGLYLCVVYVDDHIHAWGHMTISTAAQYRNAVVEQHLPQRQPEPVEPTRPHVRAPPPAPSARGPLRLGAMLGAALLLAALGLSAWACMTCWRRRSWRAVKSRASATGPTYIRVADSELYADWSSDSEGERDGSLWQDPPERPDSPSTNGSGFEILSPTAPSVYPHSEGRKSRRPLTTFGSGSPGRRHSQASYPSVLW

SEQ ID NO: 216 - protein, 547 aa, Herpes Simplex Virus Type 2
ARGAGLVFFVGVWVVSCLAAAPRTSWKRVTSGEDVVLLPAPAGPEERTRAHKLLWAAEPLDACGPLRPSWVALWPPRRVLETVVDAACMRAPEPLAIAYSPPFPAGDEGLYSELAWRDRVAVVNESLVIYGALETDSGLYTLSVVGLSDEARQVASVVLVVEPAPVPTPTPDDYDEEDDAGVSERTPVSVPPATPPRRPPVAPPTHPRVIPEVSHVRGVTVHMETPEAILFAPGETFGTNVSIHAIAHDDGPYAMDVVWMRFDVPSSCAEMRIYEACLYHPQLPECLSPADAPCAVSSWAYRLAVRSYAGCSRTTPPPRCFAEARMEPVPGLAWLASTVNLEFQHASPQHAGLYLCVVYADDHIHAWGHMTISTAAQYRNAVVEQHLPQRQPEPVEPTRPHVRAPHPAPSARGPLRLGAVLGAALLLAALGLSAWACMTCWRRRSWRAVKSRASATGPTYIRVADSELYADWSSDSEGERDGSLWQDPPERPDSPSTNGSGFEILSPTAPSVYPHSEGRKSRRPLTTFGSGSPGRRHSQASYPSVLW

SEQ ID NO: 217 - DNA, 1376 bp, Herpes simplex virus
cgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatgggggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctgaggatgcccgccagggccgcggtgatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagc

SEQ ID NO: 218 - DNA, 1599 bp, Herpes simplex virus; identical to SEQ ID NO: 144

SEQ ID NO: 219 - DNA, 746 bp, Herpes simplex virus
cgtcgcgcccctcatcgtcggcctgaccgtggagagcgggtttgaggccaacgtggccgcggtcgtcgggtcccgcacgacgggccttggggggaccgcggtgtccctcaagcttatgccctcgcactacagcccgtccgtctacgtctttcacggcggccgccacctggcccccagcacccaggcccccaacctgacgcggctctgcgagcgggcgcgccgccattttggcttctcggactacgcgccccggccctgcgacctaaagcacgagacgacgggggacgcgctgtgcgagcggctcggactggacccggaccgggccttgctgtatctggtgatcacggagggcttccgggaggccgtgtgcatcagcaacaccttcctgcacctgggcgggatggacaaggtaaccatcggggacgcggaggttcaccgcatccccgtgtatccgctgcagatgtttatgccggattttagccgggtcatcgccgatccgtttaactgcaaccaccgatcgatcggggagaatttcaactacccccttccgtttttcaaccgccccctcgcccgcctgctgttcgaggcggtcgtcgggcccgccgccgtggccctgcgtgctcggaacgtggacgccgtggcccgcgcggccgcccacctggcgttcgacgaaaaccacgagggcgcggccctccccgccgacattacgttcacggccttcgaggccagccagggtaagccccagc

SEQ ID NO: 220 - DNA, 823 bp, Herpes simplex virus
ggcctggagctgctgtcgctactgtcggcgcgcagcggcgacgcggacgtcgccgtcgcgcccctcatcgtcggcctgaccgtggagagcgggtttgaggccaacgtggccgcggtcgtcgggtcccgcacgacgggccttggggggaccgcggtgtccctcaagcttatgccctcgcactacagcccgtccgtctacgtctttcacggcggccgccacctggcccccagcacccaggcccccaacctgacgcggctctgcgagcgggcgcgccgccattttggcttctcggactacgcgccccggccctgcgacctaaagcacgagacgacgggggacgcgctgtgcgagcggctcggactggacccggaccgggccttgctgtatctggtgatcacggagggcttccgggaggccgtgtgcatcagcaacaccttcctgcacctgggcgggatggacaaggtaaccatcggggacgcggaggttcaccgcatccccgtgtatccgctgcagatgtttatgccggattttagccgggtcatcgccgatccgtttaactgcaaccaccgatcgatcggggagaatttcaactacccccttccgtttttcaaccgccccctcgcccgcctgctgttcgaggcggtcgtcgggcccgccgccgtggccctgcgtgctcggaacgtggacgccgtggcccgcgcggccgcccacctggcgttcgacgaaaaccacgagggcgcggccctccccgccgacattacgttcacggccttcgaggccagccagggtaagccccagcggggcgcgcgcgacgccgggaacc

SEQ ID NO: 221 - DNA, 3591 bp, Herpes simplex virus; identical to SEQ ID NO: 191

SEQ ID NO: 222 - DNA, 761 bp, Herpes simplex virus
gcgcccgctcgcggctcagcgcgaggccgccggggtttacgacgcggtgcggacctgggggccagacgcggaggccgaaccggaccagatggaaaacacgtatctgctgcccgacgatgacgccgccatgcccgcgggcgtcgggcttggcgccacccccgccgccgacaccaccgccgccgcctggccggccgaaagccacgccccccgcgccccctccgaggacgcagattccatttacgagtcggtgagcgaggatggggggcgcgtctacgaggagatcccctgggttcgggtatacgaaaacatctgccttcgccggcaagacgccggcggggccgccccgccgggagacgccccggactccccgtacatcgaggcggaaaatcccctgtacgactggggcgggtctgccctcttctcccctccgggggccacacgcgccccggacccgggactaagcctgtcgcccatgcccgcccgcccccggaccaacgcgctggccaacgacggcccgacaaacgtcgccgccctcagcgccctgttgacgaagctcaaacgcggccgacaccagagccattaaaaaaatgcgaccgccggccccaccgtctcggtttccggcccctttccccgtatgtctgttttcaataaaaagtaacaaacagagaaaaaaaaacagcgagttccgcatggtttgtcgtacgcaattagctgtttattgttttttttttgggggggggaagagaaaaagaaaaaaggag

SEQ ID NO: 223 - DNA, 1031 bp, Herpes simplex virus
cggacccggcgcgacaacgcacccccgccgctcccccgggctcgcccccactcgacccccgcggcccctcggaggtgcaggcgccaccgcgaggacctccccgagcccccgcacgtcgacgcggccgaccggggtcccgagccctgcgccggccggccggccacgtattacacgcatatggccggggcgcccccgcgcctcccgccccgcaaccccgcgccccccgagcagcggccggcagccgcggcgcgcccgctcgcggctcagcgcgaggccgccggggtctacgacgcggtgcggacctgggggccggacgcggaggccgaaccggaccagatggaaaacacgtatctgctgcccgacgatgacgccgccatgcccgcgggcgtcgggcttggcgccacccccgccgccgacaccaccgccgccgccgcctggccggccgaaagccacgccccccgcgccccctccgaggacgcagattccatttacgagtcggtgggcgaggatggggggcgcgtctacgaggagatcccctgggttcgggtatacgaaaacatctgccctcgccggcgtcttgccggcggggccgccctgccgggagacgccccggactccccgtacatcgaggcggaaaatcccctgtacgactggggcgggtctgccctcttctcccctcggcgggccacacgcgccccggacccgggactaagcctgtcgcccatgcccgcccgcccccggaccaacgcgctggccaacgacggcccgacgaacgtcgccgccctcagcgccctgttgacgaagctcaaacgcggccgacaccagagccattaaaaaaatgcgaccgccggccccaccgtctcggtttccggcccctttccccgtatgtctgtttcaataaaaagtaacaaacagagaaaaaaaacagcgagttccgcatggtttgtcgtacgcaattagctgtttattgttttttttgggggggggggaagagaaaaagaaaaaaggagggtattggccaaacgccgtcg

SEQ ID NO: 224 - DNA, 2169 bp, Herpes simplex virus; identical to SEQ ID NO: 150

SEQ ID NO: 225 - DNA, 1765 bp, Herpes simplex virus
  misc_feature (1)...(1765): n = A,T,C or G
cccgatggacccacgcgacgttttggggcgggtgggcggttcgcgggtggtgccctcgccgctgttcctggacgagctcagctacgaggaggacgactaccccgccgccgtcgcgcacgatgacgncgccggggcgcggcctcccgcgacggtcgagattctcgcgggccgcgtgtcgggcccggagctgcaggcggcattccccctggaccgcctgaccccccgagtcgccgcgtgggacgagtccgtgcgctcggccctggccctgggacatccggccgggttctacccgtgtccggatagcgcgttcgggctgtcgcgcgtgggggtcatgcactttgcctccccggccgacccaaaggtgtttttccgccagacgctgcagcagggcgaggcgctggcctggtacgtcacgggcgacgcgatcctcgacntgacggatcggcgggcaaaaaccagcccctcccgcgcgatgggctttctggtggacgccatcgtgcgggtggcgatcaacgggtgggtctnngggacgcgcctgcacacggaggggcgcggctcggagctcgacgacagggcggccgagctccgacggcagttcgcgancctcnnnncgnnncgnnncgtgggggccgccgccgtgccgctgctcagcgcgggaggggccgcgcccccccaccccggccccgacgccgcggtctttcgcagttcgctggggtccctgctgtactggcccggggtgcgcgcgctcctggggcgcgactgtcgcgtggccgcccgctacgcggggcgcatgacgtacatcgccaccggggctctgctcgcccgcttcaaccccggcgccgtcaaatgcgtgctcccgcgggaggccgcgtttgcgggncgcgtcctggacgtgctggcggtcctggcggagnagacggtccagtggctctcggtggtcgtgggggcgcgcctgcacccgcactccgcccaccccgcgtttgcggacgtggagcaggaggcgctgtttcgcgccctgcccctgggtagccccggggtcgtggcggccgagcacgaggcgctgggcgacaccgcggcgcgccgcctgctcgccaccagcgggctgaacgccgtgctgggcgcggccgtgtacgcgctgcacacggccctggcgaccgttaccctgaaatacgccctggcntgcggggacgcnngccggcgcagggacgacgcggcggccgcgcgcgccgtgctggcgacggggctcatcctgcagcggctgctgggcctggccgacacggtggtcgcgtgcgtggccctggccgcgtttgacggcgggtcgacggcccccgaggtgggcacgtacacccccctgcgctacgcgtgcgtcctccgcgcgacccagcccctgtacgcgcggaccacccccgccaaattttgggcggacgtgcgcgccgccgcggaacacgtggaccttcgccccgcgtcctcggcgccccgggcgcccgtgagcgggacggcagaccccgccttcctgctcgaagacctggcggccttcccccccgcccccctgaatagcgagtccgtgctggggccgcgggtccgcgtcgtggacatcatggcgcagtttcggaaactgctcatgggcgacgaggagaccgccgccntccgggcgcacgtgtccgggaggcgcgcgaccgggctgggcggcccgccacgcccataggcgcctccccataaaaagcaaccctatatcccgggacgcggcatacctccgaccggcggg

SEQ ID NO: 226 - DNA, 2091 bp, Herpes simplex virus; identical to SEQ ID NO: 78

SEQ ID NO: 227 - protein, 292 aa, Herpes simplex virus
VQVKHIDRVVSPSVSSAPPPSAPDASLPPPGLQEAAPPGPPLRELWWVFYAGDRALEEPHAESGLTREEVRAVHGFREQAWKLFGSVGAPRAFLGAALALSPTQKLAVYYYLIHRERRMSPFPALVRLVGRYIQRHGLYVPAPDEPTLADAMNGLFRDALAAGTVAEQLLMFDLLPPKDVPVGSDARADSAALLRFVDSQRLTPGGSVSPEHVMYLGAFLGVLYAGHGRLAAATHTARLTGVTSLVLTVGDVDRMSAFDRGPAGAAGRTRTAGYLDALLTVCLARAQHGQSV

SEQ ID NO: 228 - protein, 532 aa, Herpes simplex virus; identical to SEQ ID NO: 154

SEQ ID NO: 229 - protein, 20 aa, Herpes simplex virus
PLRELWWVFYAGDRALEEPH

SEQ ID NO: 230 - protein, 248 aa, Herpes simplex virus
VAPLIVGLTVESGFEANVAAVVGSRTTGLGGTAVSLKLMPSHYSPSVYVFHGGRHLAPSTQAPNLTRLCERARRHFGFSDYAPRPCDLKHETTGDALCERLGLDPDRALLYLVITEGFREAVCISNTFLHLGGMDKVTIGDAEVHRIPVYPLQMFMPDFSRVIADPFNCNHRSIGENFNYPLPFFNRPLARLLFEAVVGPAAVALRARNVDAVARAAAHLAFDENHEGAALPADITFTAFEASQGKPQ

SEQ ID NO: 231 - protein, 274 aa, Herpes simplex virus
GLELLSLLSARSGDADVAVAPLIVGLTVESGFEANVAAVVGSRTTGLGGTAVSLKLMPSHYSPSVYVFHGGRHLAPSTQAPNLTRLCERARRHFGFSDYAPRPCDLKHETTGDALCERLGLDPDRALLYLVITEGFREAVCISNTFLHLGGMDKVTIGDAEVHRIPVYPLQMFMPDFSRVIADPFNCNHRSIGENFNYPLPFFNRPLARLLFEAVVGPAAVALRARNVDAVARAAAHLAFDENHEGAALPADITFTAFEASQGKPQRGARDAGN

SEQ ID NO: 232 - protein, 1196 aa, Herpes simplex virus; identical to SEQ ID NO: 200

SEQ ID NO: 233 - protein, 193 aa, Herpes simplex virus; identical to SEQ ID NO: 55

SEQ ID NO: 234 - protein, 277 aa, Herpes simplex virus
RTRRDNAPPPLPRARPHSTPAAPRRCRRHREDLPEPPHVDAADRGPEPCAGRPATYYTHMAGAPPRLPPRNPAPPEQRPAAAARPLAAQREAAGVYDAVRTWGPDAEAEPDQMENTYLLPDDDAAMPAGVGLGATPAADTTAAAAWPAESHAPRAPSEDADSIYESVGEDGGRVYEEIPWVRVYENICPRRRLAGGAALPGDAPDSPYIEAENPLYDWGGSALFSPRRATRAPDPGLSLSPMPARPRTNALANDGPTNVAALSALLTKLKRGRHQSH

SEQ ID NO: 235 - protein, 722 aa, Herpes simplex virus; identical to SEQ ID NO: 15

SEQ ID NO: 236 - protein, 19 aa, Herpes simplex virus
EEIPWVRVYENICLRRQDA

SEQ ID NO: 237 - protein, 567 aa, Herpes simplex virus
  VARIANT (1)...(567): Xaa = Any Amino Acid
PMDPRDVLGRVGGSRVVPSPLFLDELSYEEDDYPAAVAHDDXAGARPPATVEILAGRVSGPELQAAFPLDRLTPRVAAWDESVRSALALGHPAGFYPCPDSAFGLSRVGVMHFASPADPKVFFRQTLQQGEALAWYVTGDAILDXTDRRAKTSPSRAMGFLVDAIVRVAINGWVXGTRLHTEGRGSELDDRAAELRRQFAXLXXXRXVGAAAVPLLSAGGAAPPHPGPDAAVFRSSLGSLLYWPGVRALLGRDCRVAARYAGRMTYIATGALLARFNPGAVKCVLPREAAFAGRVLDVLAVLAEXTVQWLSVVVGARLHPHSAHPAFADVEQEALFRALPLGSPGVVAAEHEALGDTAARRLLATSGLNAVLGAAVYALHTALATVTLKYALACGDAXRRRDDAAAARAVLATGLILQRLLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAAXRAHVSGRRATGLGGPPRP

SEQ ID NO: 238 - protein, 696 aa, Herpes simplex virus
MSVRGHAVRRRRASTRSHAPSAHRADSPVEDEPEGGGVGLMGYLRAVFNVDDDSEVEAAGEMASEEPPPRRRREARGHPGSRRASEARAAAPPRRASFPRPRSVTARSQSVRGRRDSAITRAPRGGYLGPMDPRDVLGRVGGSRVVPSPLFLDELNYEEDDYPAAVAHDDGPGARPSATVEILAGRVSGPELQAAFPLDRLTPRVAAWDESVRSALALGHPAGFYPCPDSAFGLSRVGVMHFASPADPKVFFRQTLQQGEALAWYVTGDAILDLTDRRAKTSPSRAMGFLVDAIVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQRLLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAALRAHVSGRRATGLGGPPRP

SEQ ID NO: 239 - protein, 19 aa, Herpes simplex virus
LGRVGGSRVVPSPLFLDEL

SEQ ID NO: 240 - DNA, 725 bp, Herpes simplex virus
ccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcag

SEQ ID NO: 241 - protein, 241 aa, Herpes simplex virus
TPNPRRRVSRNAHNQGGRHPASARTDGPGATHGEARRGGEQLDVSGGPRPRGTRQAPPPLMALSLTPPHADGRAPVPERKAPSADTIDPAVRAVLRSISERAAVERISESFGRSALVMQDPFGGMPFPAANSPWAPVLATQAGGFDAETRRVSWETLVAHGPSLYRTFAANPRAASTAKAMRDCVLRQENLIEALASADETLAWCKMCIHHNLPLRPQDPIIGTAAAVLENLATRLRPFLQ

SEQ ID NO: 242 - DNA, 1539 bp, Herpes simplex virus; identical to SEQ ID NO: 147

SEQ ID NO: 243 - protein, 512 aa, Herpes simplex virus; identical to SEQ ID NO: 156

SEQ ID NO: 244 - DNA, 1921 bp, Herpes simplex virus
accgcggccctggcgggcatcctcagggtggtccgaacgtgcgtcccatttttgtggagacgcgaataaacgggtgtgtggacgcagcggcgtccacgcccaacccaaccgactccctccgtgtccgcggtctgtttgttattgtgtccgccgtgcgtccgctaccgcctctgttcctttcccttctccattcctgtttcctttcctttccccccccccatagtcccccgtataggcatacaacggcatccgtgggttagaaaacgactgcactttattgggatatctcacacagactggccgtgctgggcgcgagccaggcaaacggtaagcagcgcgtccaggtacccggcggttcgcgtgcggccagtgggtccgacgaggccttcccgatcgagtacgtcctgcggctcatgaacgactgggccgatgtgccctgcaacccctacctgcgcgtgcagaacaccggcgtttcggtgctgtttcagggtttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggcggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggttgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgccccccctttcccccttcccgggtggttcaataaaaaacaccaacatacgatattcgcgtttgatacgtttattggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtc

SEQ ID NO: 245 - DNA, 1599 bp, Herpes simplex virus; identical to SEQ ID NO: 144

SEQ ID NO: 246 - DNA, 2517 bp, Herpe simplex virus; identical to SEQ ID NO: 38

SEQ ID NO: 247 - DNA, 9369 bp, Herpes simplex virus; identical to SEQ ID NO: 190

SEQ ID NO: 248 - protein, 532 aa, Herpes simplex virus; identical to SEQ ID NO: 154

SEQ ID NO: 249 - protein, 838 aa, Herpes simplex virus; identical to SEQ ID NO: 45

SEQ ID NO: 250 - protein, 3122 aa, Herpes simplex virus; identical to SEQ ID NO: 201

SEQ ID NO: 251 - DNA, 625 bp, Herpes simplex virus
cggacgctccccccggctcgccagcccccccaccccccgaacatcgcggcggacccgaggagtttgagggcgccggggacggcgaaccccccgatgacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtggggtgggggcgagaaacgatgaaggacgggaaagggaacagcgaccaaatgccacgataagaacaataaacctgtgacgtcaatcggatatgtgagtttggttgtgttttgtgggactgctcgtgccgctcgtgccgctcgtgccg

SEQ ID NO: 252 - DNA, 2100 bp, Herpes simplex virus; identical to SEQ ID NO: 179

SEQ ID NO: 253 - protein, 156 aa, Herpes simplex virus
DAPPGSPAPPPPEHRGGPEEFEGAGDGEPPEDDDSATGLAFRTPNPNKPPPARPGPIRPTLPPGILGPLAPNTPRPPAQAPAKDMPSGPTPQHIPLFWFLTASPALDILFIISTTIHTAAFVCLVALAAQLWRGRAGRRRYAHPSVRYVCLPPERD

SEQ ID NO: 254 - protein, 699 aa, Herpes simplex virus; identical to SEQ ID NO: 143

What is claimed:

1. An isolated polypeptide comprising at least an immunogenic portion of an HSV antigen, wherein said antigen consists of an amino acid sequence set forth in any one of SEQ ID NO: 239.

2. A fusion protein comprising a polypeptide according to claim 1 and an unrelated fusion partner.

3. A fusion protein according to claim 2, wherein the fusion partner comprises a T helper epitope that is not present within the polypeptide of claim 1.

4. A fusion protein according to claim 2, wherein the fusion partner comprises an affinity tag.

5. A pharmaceutical composition comprising a polypeptide according to claim 1 or a polynucleotide encoding said polypeptide, and a physiologically acceptable carrier.

6. A pharmaceutical composition comprising a polypeptide according to claim 1, or a polynucleotide encoding said polypeptide, and an immunostimulant.

7. The pharmaceutical composition of claim 6, wherein the immunostimulant is selected from the group consisting of a monophosphoryl lipid A, aminoalkyl glucosaminide phosphate, saponin, or a combination thereof.

8. A method for stimulating an immune response in a patient, comprising administering to a patient a pharmaceutical composition according to any one of claims 5–7.

* * * * *